(12) United States Patent
Clermont et al.

(10) Patent No.: US 8,178,340 B2
(45) Date of Patent: May 15, 2012

(54) **HUMAN SPECIFIC *ESCHERICHIA COLI* STRAINS**

(75) Inventors: Olivier Clermont, Romainville (FR); Erick Denamur, Paris (FR); Tony Le Gall, Brest (FR); Olivier Tenaillon, Chatenay Malabry (FR)

(73) Assignee: INSERM (Institut National de la Sante et de la Recherche Medicale), Paris (FR)

( * ) Notice: Subject to any disclaimer, the term of this patent is extended or adjusted under 35 U.S.C. 154(b) by 0 days.

(21) Appl. No.: 12/673,614

(22) PCT Filed: Aug. 13, 2008

(86) PCT No.: PCT/EP2008/060648
§ 371 (c)(1),
(2), (4) Date: Feb. 16, 2010

(87) PCT Pub. No.: WO2009/021977
PCT Pub. Date: Feb. 19, 2009

(65) Prior Publication Data
US 2011/0008449 A1    Jan. 13, 2011

(30) Foreign Application Priority Data

Aug. 16, 2007    (EP) ..................................... 07301308

(51) Int. Cl.
*C12N 1/20*    (2006.01)

(52) U.S. Cl. ................. 435/252.33; 435/243; 435/252.1; 424/241.1

(58) Field of Classification Search ........................ None
See application file for complete search history.

(56) References Cited

OTHER PUBLICATIONS

Clermont et al., Environmental Microbiology, 10(4):1000-1006 (2008).
Escobar-Paramo et al., Mol. Biol. Evol., 21(6):1085-1094 (2004).
Johnson et al., J. Infect. Dis., 194:1141-1150 (2006).
Le Gall et al., Mol. Biol. Evol., 24(11):2373-2384 (2007).

*Primary Examiner* — Jennifer Graser
(74) *Attorney, Agent, or Firm* — McAndrews, Held & Malloy Ltd.

(57) ABSTRACT

The present invention relates to human specific *Escherichia coli* strains.

4 Claims, 2 Drawing Sheets

A

B

HUMAN SPECIFIC ESCHERICHIA COLI STRAINS

Figure 1:
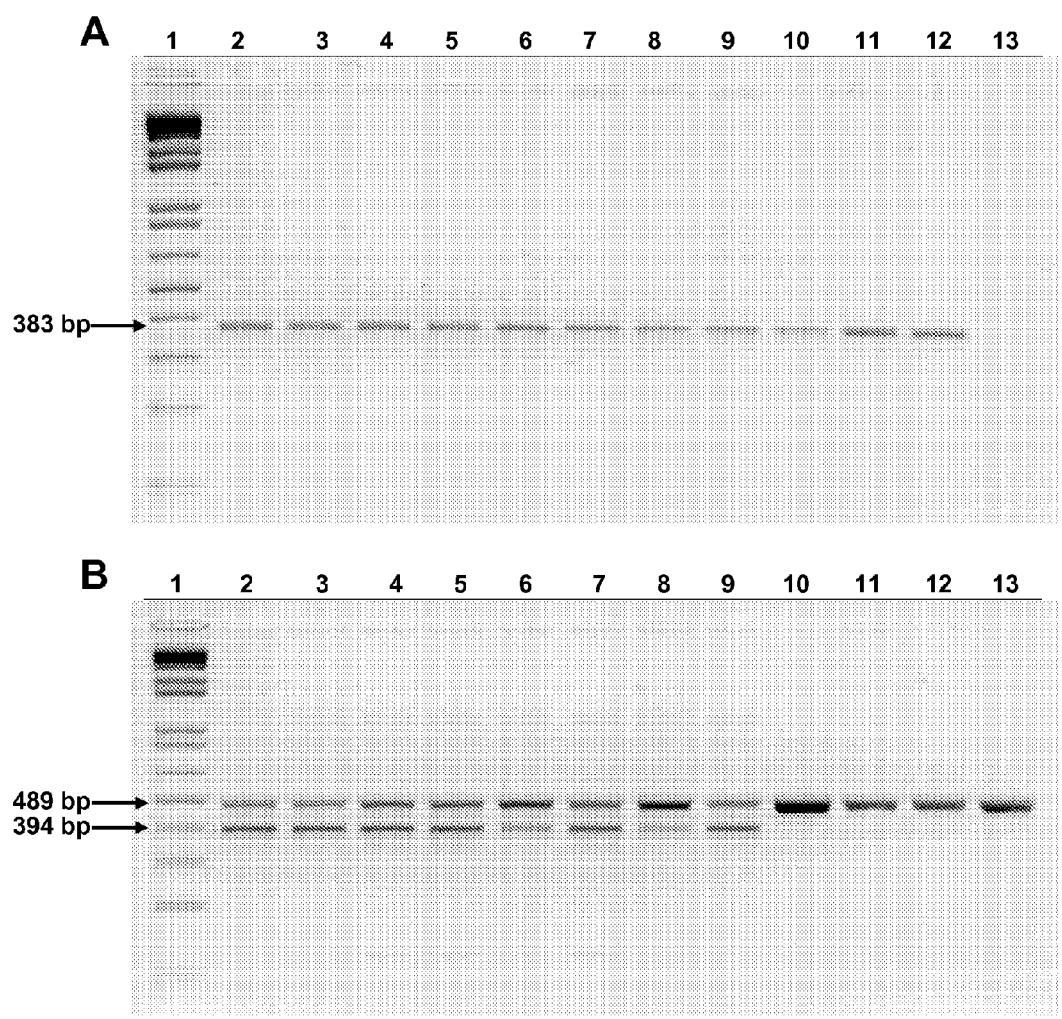

The present application is filed pursuant to 35 U.S.C. 371 as a U.S. National Phase application of International Patent Application No. PCT/EP08/60648, which was filed Aug. 13, 2008, claiming the benefit of priority to European Patent Application No. 07301308.8, which was filed on Aug. 16, 2007. The entire text of the aforementioned applications is incorporated herein by reference in its entirety.

FIELD OF THE INVENTION

The present invention relates to *Escherichia coli* strains

BACKGROUND OF THE INVENTION

*Escherichia coli* is a widespread commensal of the lower intestinal tract of humans and other vertebrates that occasionally causes intestinal and extra-intestinal diseases (Donnenberg 2002). *E. coli* is used as a probiotic but the currently used probiotic strains, Nissle O6 strain (Mutaflor®) isolated in 1917 from the faeces of a healthy soldier (Sun et al., 2005) and the A0 34/36 O83 strain isolated from porcine faeces (Hejnova, et al., 2005), are highly virulent in a mouse model of extra-intestinal virulence (Johnson et al., 2006).

*E. coli* colonizes a wide variety of hosts with very diverse gut morphologies and digestive physiologies. *E. coli* also exhibits quite substantial genetic structure, with most commensal isolates belonging to one of four genetic groups (A, B1, D and B2) (Herzer et al., 1990). The great majority of *E. coli* strains belonging to genetic group B2 are highly virulent in a mouse model (Johnson et al., 2006).

Epidemiological studies have only demonstrated weak associations between host species and the prevalence of strains of the four phylogenetic groups (Gordon and Cowling 2003; Escobar-Páramo et al., 2006). Although the frequency of the four genetic groups varies to some degree with the diet or body mass of the host from which it was isolated, other factors such as climate, the year of sampling, or the domestication status of the animals sampled (wild versus domesticated) also shape the global genetic structure of *E. coli*. To date, no strong association between a particular clone and a given host species has been found, except perhaps for a hly B1 clone that appears to be restricted to animals (Gordon and Cowling 2003; Escobar-Páramo et al., 2004b; Escobar-Páramo et al., 2006).

*E. coli* has been used for many years to assess water quality and to determine the source of any faecal pollution that might occur in a water body (Scott et al., 2002). However, the use of *E. coli* in these efforts has been hampered by the apparent lack of any extensive host-specificity in *E. coli* (Gordon, 2001) and by the ability of many *E. coli* strains to undergo significant cell division in the external environment (Barnes and Gordon, 2004; Power et al., 2005). The usefulness of the microbial indicators as tool risk assessment can be significantly enhanced by the identification of a human specific clone.

SUMMARY OF THE INVENTION

The invention relates to human specific *Escherichia coli* strains which are avirulent and uses thereof.

DETAILED DESCRIPTION OF THE INVENTION

The present invention relates to strains of *Escherichia coli* of O81 serotype belonging to the B2 subgroup VIII.

These strains are human specific and avirulent.

The serotype of the strains according to the invention may be determined via traditional serology (Dr Chobi Deb Roy, *E. coli* reference center, Pennsylvania State University, USA) or O81 specific primer pair may be used. For example an O81 specific forward primer (rfbO81bis.r: 5'-GAGCAG-TATATATTACTGGTG-3' (SEQ ID NO: 10)), together with a reverse primer (gndbis.f: 5'-ATACCGACGACGC-CGATCTG-3' (SEQ ID NO: 11)) can be used).

Primers to confirm that a strain is a member of the B2 clonal group VIII may be used. For example specific primers for the trpA gene may be used, in particular the forward primer (trpAVIII.f: 5'-GCGCAAAGAAGGCGCATTCA-3' (SEQ ID NO: 8)) which is specific to B2 VIII strains together with a non-specific trpA reverse primer (trpA2.r: 5'-GCAACGCGGCCTGGCGGAAG-3' (SEQ ID NO: 9)).

By "avirulent" it is meant a strain which does not cause disease in human subjects. Avirulent strains do not present extraintestinal nor intestinal virulence in human subjects.

The extraintestinal virulence of the strain may be assessed by using a mouse model of systemic infection, such as that described in Picard et al. (1999) or in Johnson et al. (2006). Typically, a strain that is avirulent in a mouse model of systemic infection is not responsible for extra-intestinal infection in human.

The intestinal virulence of the strain is directly related to the enteroaggregative phenotype of said strain. This phenotype, also called "aggregative adherence" can be tested in a cellular model of adherence on Hep-2 cells (see Nataro et al., 1998) and is due to the presence of the AAF-II gene present on a plasmid.

A strain according to the invention may be isolated and purified from human gastrointestinal tract.

In a preferred embodiment, a strain according to the invention comprises six sequences with at least 99% identity with SEQ ID NO: 1, SEQ ID NO: 2, SEQ ID NO: 3, SEQ ID NO: 4, SEQ ID NO: 5 and SEQ ID NO: 6 respectively.

Typically a strain according to the invention comprises six sequences with at least 99.5% identity, for example at least 99.9% identity, with SEQ ID NO: 1, SEQ ID NO: 2, SEQ ID NO: 3, SEQ ID NO: 4, SEQ ID NO: 5 and SEQ ID NO: 6 respectively.

SEQ ID NO: 1 to 6 correspond respectively to the sequences of the following genes: trpA, trpB, pabB, putP, icd, polB.

The percentage of identity may be determined by using algorithms commonly employed by those skilled in this art. Methods of alignment of sequences for comparison are well known in the art. Thus, the determination of percent identity between any two sequences can be accomplished using a mathematical algorithm. Non-limiting examples of such mathematical algorithms are the algorithm of Myers and Miller (1988), the local homology algorithm of Smith et al. (1981), the homology alignment algorithm of Needleman and Wunsch (1970), the search-for-similarity-method of Pearson and Lipman (1988), the algorithm of Karlin and Altschul (1990) modified as in Karlin and Altschul (1993). Computer implementations of these mathematical algorithms can be utilized for comparison of sequences to determine sequence identity. Such implementations include, but are not limited to: CLUSTAL in the PC/Gene program (available from Intelligenetics, Mountain View. Calif.); the ALIGN program (Version 2.0) and GAP, BESTFIT. BLAST, FASTA, and TFASTA in the Wisconsin Genetics Software Package, Version 8 (available from Genetics Computer Group (GCG), 575 Science Drive, Madison, Wis., USA). Alignments using these programs can be performed using the default parameters.

A preferred embodiment of the invention relates to a strain of *Escherichia coli* called ED1a deposited at the COLLECTION NATIONALE DE CULTURES DE MICROORGANISMES (CNCM, Institut Pasteur, 25 rue due Docteur Roux, 75724 Paris CEDEX 15-France) on Mar. 29, 2007 in accordance with the terms of the Budapest Treating under the accession number CNCMI-3734.

The genome of ED1a has been fully sequenced. The sequence of the genome of ED1a is set forth in SEQ ID NO: 7.

A strain according to the invention may be used as a probiotic. Typically the strains according to the invention may have the same type of applications as the Nissle O6 strain or the A0 34/86 O83 strain.

Typically a strain according to the invention may be used for the treatment and/or prevention of a disease in a subject in need thereof.

In a preferred embodiment said disease may be selected from the group consisting of bowel diseases such as ulcerative colitis, Crohn's disease, inflammatory bowel diseases, pouchitis, collagenous colitis, irritable bowel syndrome, chronic constipation, chronic diarrhea, antibiotic-associated pseudomembranous colitis, diverticular disease of the colon, intestinally caused halitosis, polymorphous light eruption, non-ulcer dyspepsia, food intolerance, food malabsorptions, and mycoses of the orogastrointestinal tract.

In a preferred embodiment said disease is an extra-intestinal *E. coli* infection.

An embodiment of the invention relates to a method of treatment and/or prevention of a disease, comprising administering in a subject in need thereof a therapeutically effective amount of a strain according to invention.

In the context of the invention, the term "treating" or "treatment", as used herein, means reversing, alleviating, inhibiting the progress of, or preventing the disorder or condition to which such term applies, or reversing, alleviating, inhibiting the progress of, or preventing one or more symptoms of such a disorder or condition.

By a "therapeutically effective amount" of a strain according to the invention is meant a sufficient amount of the strain to treat said disease, at a reasonable benefit/risk ratio applicable to any medical treatment. It will be understood, however, that the total daily usage of the strain of the present invention will be decided by the attending physician within the scope of sound medical judgment. The specific therapeutically effective dose level for any particular subject will depend upon a variety of factors including the disease being treated and the severity of the disease, the age, body weight, general health, sex and diet of the subject, the time of administration, route of administration, the duration of the treatment; drugs used in combination or coincidental with the strain employed, and like factors well known in the medical arts.

Typically strains according to the invention may be lyophilized and supplied to a subject in need thereof in enteric-coated formulations, such as capsules or tablets. An embodiment of the invention relates to an enteric-coated formulation comprising lyophilized strain according to the invention. Typically an enteric coated formulation may contain between $0.1 \times 10^9$ to $30 \times 10^9$ bacteria according to the invention.

A strain according to the invention may be genetically modified and thus contain one or more heterologous nucleotide sequences and may be used for example as a bacterial vector. Typically a strain according to the invention may be used for genetic vaccination or gene therapy. Non pathogenic *E. coli* have already been used for these purposes (see for review Vassaux et al. 2006).

A strain according to the invention may also be used as a biosensor (Harms et al., 2006), in particular for the detection of colorectal cancer. Cancerous cells express on their surface a number of proteins which may, when detected, be helpful in diagnosing a cancer. Typically, a strain according to the invention may be genetically modified in order to express a reporter protein. This engineered strain can then enable the detection of cancerous proteins by emitting a physiological response which can be quantified in the faeces after administration to a patient.

An embodiment of the invention relates to a method of diagnosis of a colorectal cancer, comprising administering in a subject in need thereof a genetically modified strain according to invention.

A further embodiment of the invention relates to a method for detecting a water contamination by human faeces comprising the detection of an *E. coli* strain according to the invention.

In a preferred embodiment, said detection involves a PCR step using primers which are specific to an *E. coli* strain according to the invention or using a nucleotide probe specific to an *E. coli* strain according to the invention.

In a preferred embodiment, said detection involves the use of a specific antibody against an *E. coli* strain according to the invention.

In the following, the invention will be illustrated by means of the following examples as well as the figures.

FIGURE LEGENDS

FIG. 1: Allele specific PCR of (A) the 5' portion of the rfb cluster amplifying the O81 type and (B) the trpA gene amplifying the B2 subgroup VIII. In B, the 489 bp fragment present in all tested strains corresponds to a control of amplification of trpA gene. Lane 1: molecular weight marker (1 Kb Plus DNA ladder, Invitrogen, Cergy Pontoise, France), lane 2: ED1a, lane 3: VDG427, lane 4: Ben4d, lane 5: Ben27a, lane 6: colF12g, lane 7: col 13c: lane 8: 381A, lane 9: IAI48, lane 10: O81 strain of the B1 phylogenetic group isolated from a septicaemic chicken, lane 11: O81 strain of the A phylogenetic group isolated from cotton rat faeces, line 12: O81 strain of the B2 phylogenetic group isolated from human faeces in commensal conditions, line 13: CFT073 strain of O6 type belonging to the B2 phylogenetic group. Strains from lines 2 to 9 belong to the O81 subgroup VIII clone.

Figure 2:
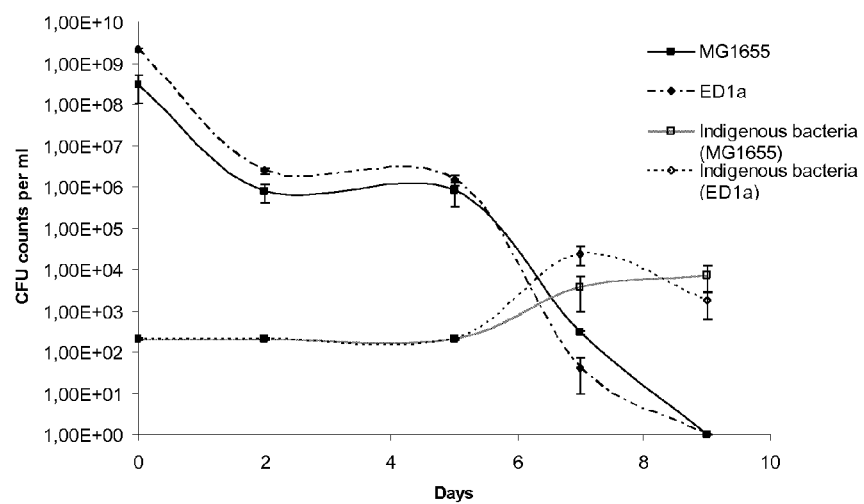
Figure 2:
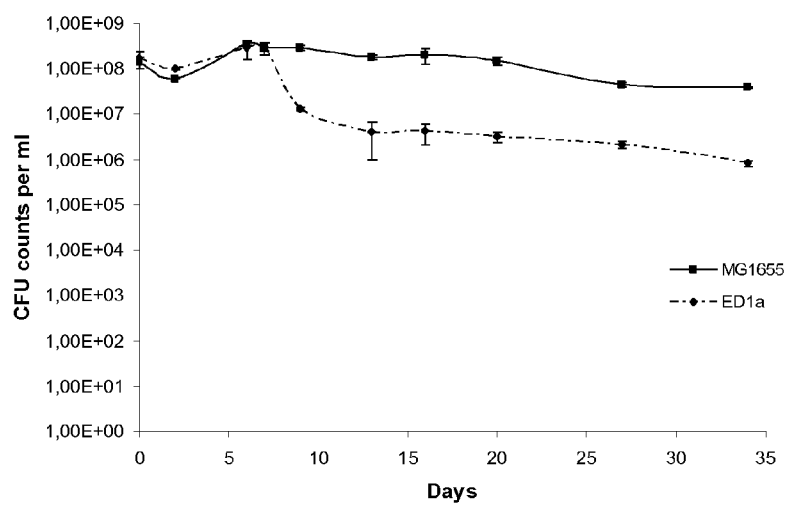

FIG. 2: Decline of K12-MG1655 and ED1a *E. coli* cells in (A) non sterile and (B) sterile water of the Saint Martin canal in Paris at 20° C. Indigenous bacteria counts are indicated in the non sterile experiment.

EXAMPLES

Experimental Procedures

Bacterial Strains

Several previously published collections were studied. A collection of 293 isolates representing all the B2 strains among 1520 isolates from the faeces of 152 humans (10 strains per individual) (Escobar-Páramo et al., 2004b). These strains originated from Benin (68 isolates from 24 subjects), Colombia (81 isolates from 18 subjects) and France (144 isolates from 25 subjects) and were obtained post 2000. Twenty five human faecal B2 isolates from 25 subjects originating from Europe (France, Sweden, Croatia), Africa (Mali) and America (USA) and sampled in the 1980's (Ochman and Selander, 1984; Duriez et al., 2001) were also studied. A collection of 378 faecal isolates (310 isolates from 87 mammals, 68 isolates from 23 birds) consisting all the B2 strains among 1930 isolates from the faeces of 405 animals (one to 10 strains per individual). These strains were sampled between 1980 and 2000 in France, Africa (Ethiopia, Cameroon, Gabon) and the Americas (French Caribbean Islands, Venezuela, U.S.A) from domestic or wild (Escobar-Páramo et al., 2006) or zoo (Ochman and Selander, 1984) animals. A collection of 55 pathogenic B2 strains from humans (one strain per patient) encompassing enteropathogenic, enteroaggregative, diffusely adhering and extra-intestinal pathovars (Ochman and Selander, 1984; Picard et al., 1999; Escobar-Páramo et al., 2004a). These strains originated from Europe (France, Sweden), America (Brazil, U.S.A.) and Africa (Central African Republic) and were collected between 1980 and 2000. The collection of strains isolated from humans living in the Canberra region of Australia was acquired by isolating a single colony from the faeces or an extra-intestinal body site of each person sampled (Gordon et al. 2005; Gordon and O'Brien, 2006). A total of 120 B2 faecal isolates and 230 B2 strains taken from extra-intestinal body sites were examined for this study. The Gordon collection of strains from native wild Australian vertebrates was acquired by selecting a single isolate from each faecal sample and a single faecal sample was taken from each host individual (Gordon and Cowling, 2003). The numbers of Australian B2 strains examined were mammals (n=234), birds (n=30), and reptiles (n=4). A collection described by Souza et al. (1999) consisting of 258 *E. coli* faecal isolates from animals was analysed. For the Souza collection a single isolate per host was taken from faecal material of the following host types; mammals (n=197), birds (n=51) and reptiles (n=10) living primarily in Central and South America. Lastly, 15 O81 *E. coli* strains isolated from the hearts of 15 chickens suffering from septicaemia in Spain during the 1990's (Blanco et al., 1997) were also studied.

PCR Screening of O81 and B2 Subgroup VIII Strains

The serotype of the B2 clonal group VIII strain ED1a was determined via traditional serology (Dr Chobi Deb Roy, *E. coli* reference center, Pennsylvania State University, USA). To design an O81 specific primer pair the approach described by Clermont et al. (2007) was used. First, the 5' extremity of the rfb cluster from ED1a was sequenced and using this sequence data an O81 specific primer was designed (rfbO81bis.r: 5'-GAGCAGTATATATTACTGGTG-3' (SEQ ID NO: 10)), this primer together with (gndbis.f: 5'-ATAC-CGACGACGCCGATCTG-3' (SEQ ID NO: 11)) yields a 383 bp fragment (FIG. 1A).

Primers to confirm that a strain was a member of the B2 clonal group VIII were designed for the trpA gene. The forward primer (trpAVIII.f: 5'-GCGCAAAGAAGGCGCAT-TCA-3' (SEQ ID NO: 8)) is specific to B2 VIII strains and together with a non-specific trpA reverse primer (trpA2.r: 5'-GCAACGCGGCCTGGCGGAAG-3' (SEQ ID NO: 9)) produces a 394 bp fragment. The universal forward primer targeting the 3' portion of trpB (trpBA.f: 5'-CGGCGATAAA-GACATCTTCA-3' (SEQ ID NO: 12)) which, together with SEQ ID NO: 9, yields a 489 bp product from all *E. coli* strains and was included in the reaction as a positive control (FIG. 1B).

PCR reactions were carried out in a 20-µl volume and contained 2 µl of 10× buffer (supplied with Taq polymerase), 20 pmol of each primer, 2 µM each dNTP, 1 U of Taq polymerase (Ozyme, St Quentin en Yvelines, France), and 3 µl of bacterial lysate. PCR reactions were performed with an Eppendorf Mastercycler with MicroAm tubes using the following amplification conditions: 4 min at 94° C., 30 cycles of 5 sec at 94° C. and 10 sec at 59° C., with a final extension step of 5 min at 72° C. PCR products were loaded on 2% agarose gels containing SYBR® Safe DNA gel strain (Invitrogen, Cergy Pontoise, France) and visualized and photographed under UV light.

MLST Analysis

The phylogenetic relationships among the strains were inferred using nucleotide sequence data from 6 essential genes [trpA, trpB, pabB, putP, icd, and polB (Gerdes et al. 2003)] which are thought to experience little recombination and produce a strong phylogenetic signal (Escobar-Páramo et al. 2004c). Sequence data for the 6 genes was concatenated and aligned.

Virulence Gene Detection

The following 19 genes, usually considered as "virulence determinants" and involved in capsule synthesis (neuC), adhesion (papC, papG, sfa/foc), toxin production (hly, cnf1), iron metabolism (iron, ireA, aer, aer, fyuA, irp2, iha) and other traits (hra, sat, usp, ompT, ibeA, malX, traT), were detected by using established simplex or multiplex PCR assays (Johnson et al., 2006).

Survival of *E. coli* Strains in Water

The river water used was obtained from the Saint Martin canal in Paris at a site about 1 km upstream from the Seine. For the sterile water studies, the water was autoclaved for 45 min. One hundred-milliliter aliquots of water were placed into 250-milliliter Erlenmeyer flasks capped with paper covers. After inoculation, the flasks were incubated at 20° C. under a 12:12 light:dark cycle. Indigenous bacteria were present at a level of about $2 \times 10^2$ CFU/ml of river water. Fresh cultures of the strains K12-MG1655 and ED1a that had been grown for 14 h in 10 ml of Luria-Bertani (LB) medium, were washed with sterile 0.9% saline, centrifuged, re-suspended in 1 ml and added to the water. Samples for counting were removed directly from the water, diluted and plated on Drigalsky and LB (non-sterile water) or LB (sterile water) media. In the non-sterile water experiment, the differentiation between indigenous and inoculated bacteria was based on colony morphology and O81 PCR assay. All experiments were done in duplicate.

Mouse Lethality Assay

A mouse model of systemic infection was used to assess the intrinsic virulence of the O81 strains (Picard et al., 1999). For each strain, 10 outbred female Swiss OF1 mice (3-4 weeks old, 14-16 gm) were challenged subcutaneously in the abdomen with a standardized bacterial inoculum ($10^9$ cfu/ml of log-phase bacteria in 0.2 ml Ringer solution). Mortality was assessed over 7 days post-challenge. The urosepsis strains CFT073 was used as a positive control and the faecal-derived strain K12-MG1655 as a negative control. In this model system, lethality is a rather clear-cut parameter and strains were usually classified as non killer (strains killing <2 mice out of 10) or killer (strains killing >8 mice) (Johnson et al., 2006).

Enteroaggregation Assay

Aggregative adherence is tested in a cellular model on Hep-2 cells, as described in Nataro et al., 1998.

Results

Global Distribution of the B2 VIII/O81 Clone

A total of 1369 strains belonging to phylogenetic group B2 representing 438 faecal and 285 clinical isolates from humans, as well as 646 isolates from the faeces of wild, domestic and zoo animals were screened using the O81 specific primer. An additional 258 isolates from non-domestic animal faeces, whose phylogenetic group membership had not been determined, were also screened, as well as 15 O81 strains of undetermined phylogenetic group from septicaemic chickens. All O81 positive strains were screened using the B2 clonal group VIII specific primers and, if unknown, their phylogenetic group membership was determined.

Despite surveying strains from over sixty animal species living on four continents, none of the animal isolates were found to possess the O81 locus and to be members of B2 clonal group VIII. By contrast, 64 members of the B2 VIII/O81 clone were detected among the human isolates (FIG. 1). Two of the B2 VIII/O81 strains were clinical isolates; one strain was responsible for a urinary tract infection, IAI48 (Picard et al., 1999) and the other was an enteroaggregative strain responsible for a case of diarrhoea, 381A (Escobar-Páramo et al., 2004a). B2 VIII/O81 strains were isolated from humans living in Africa, the Americas, and Europe, but not from people living in Australia.

Seven B2 strains from both non-human vertebrates and humans yielded an O81 PCR product but were not members of the B2 clonal group VIII, indicating that the O81 serotype can be found outside the B2 clonal group VIII. Further, 18 O81 positive strains belonging to phylogenetic groups A and B1 were detected [3 strains (1 group A and 2 group B1) from mammals living in the Americas, as well as 15 B1 strains from chickens sampled in Spain]. All of the O81 strains that were not members of the B2 clonal group VIII exhibited a polymorphic pattern of virulence determinants, that was, in every case, distinct from the B2 VIII/O81 clone (data not shown).

To assess the degree of sequence type diversity among the B2 VIII/O81 strains, we choose 6 isolates from different hosts and geographical regions, as well as the two disease causing isolates (Table 1) for further characterisation. We first performed MLST by sequencing 6 essential genes (6021 bp) in these strains. The sequences were all identical except for one strain (BEN4d) that has a synonymous polymorphism in the putP gene.

We also performed an in silico search for strains of the B2 VIII/O81 clone in the Max Planck Institute MLST database (http://web.mpiib-berlin.mpg.de/mlst/dbs/Ecoli). This database contained, at the time it was searched, data for 1404 disease and faecal isolates largely recovered from humans and domesticated animals. To accomplish this search, the allele sequence for each of the seven genes used in this MLST scheme (adk, fumC, gyrB, icd, mdh, recA and purA) was determined for the B2 VIII/O81 strain ED1a. Only one strain (M716, ST 452), an isolate from an Australian mammal, matched the profile of ED 1a. However, this isolate does not yield an O81 PCR product, and M716 differs from ED1a at 7 bases over the 727 nucleotides of trpA locus, including the allele specific site of the trpAVIII.f primer, as well as in its virulence profile.

We also tested the strains for the presence of AAF-II gene, responsible for the aggregative adherence phenotype. This gene was only present in the 381A strain.

Virulence Characteristics of B2 VIII/O81 Strains

The 8 B2 VIII/O81 strains were tested in an experimental mouse model of extra-intestinal virulence. Whereas most B2 strains exhibit a high virulence in such a model (Johnson et al., 2006), none of the tested strains had any virulence in this extra-intestinal model. We then screened the isolates for the presence of 19 putative virulence determinants associated with extra-intestinal disease. All the strains exhibited a similar virulence gene profile (Table 1). The iron metabolism genes ireA, aer and iha were present in all strains. However, the genes fyuA, and irp2, which are markers for the high pathogenicity island, were absent from some strains.

Intestinal virulence is tested in the cellular model for aggregative adherence. The 381A strain is found to be enteroaggregative in this model.

TABLE 1

Principal characteristics of the 8 representative human O81 B2 subgroup VIII clone strains studied

| Strain | Host origin | Condition of isolation | neuC | papC | papG | sfa/foc | hly | cnf1 | iroN | ireA |
|---|---|---|---|---|---|---|---|---|---|---|
| ED1a | France | Com[a] | − | − | − | − | − | − | − | + |
| VDG427 | France | Com | − | − | − | − | − | − | − | + |
| Ben4d | Benin | Com | − | − | − | − | − | − | − | + |
| Ben27a | Benin | Com | − | − | − | − | − | − | − | + |
| colF12g | Colombia | Com | − | − | − | − | − | − | − | + |
| colH13c | Colombia | Com | − | − | − | − | − | − | − | + |
| 381A | Central African Republic | Diarrhea (EAEC[b]) | − | − | − | − | − | − | − | + |
| IAI48 | France | UTI[c] | − | − | − | − | − | − | − | + |

| Strain | aer | fyuA | irp2 | iha | hra | sat | usp | ompT | ibeA | malX | traT |
|---|---|---|---|---|---|---|---|---|---|---|---|
| ED1a | + | + | + | + | − | − | + | + | − | + | − |
| VDG427 | + | − | − | + | − | − | + | + | − | + | − |
| Ben4d | + | − | − | + | − | − | + | + | − | + | − |
| Ben27a | + | + | + | + | − | − | + | + | − | + | − |
| colF12g | + | + | + | + | − | − | + | + | − | + | − |
| colH13c | + | − | − | + | − | − | + | + | − | + | − |
| 381A | + | − | − | + | − | − | + | + | − | + | − |
| IAI48 | + | − | − | + | − | − | + | + | − | + | − |

[a]Commensal
[b]Entero aggregative E. coli
[c]Urinary tract infection

Fine Scale Analysis of the Epidemiologic Data

In a sample of faecal isolates collected post 2000 from 152 people living in Colombia, Benin, and France, and considering one randomly selected isolate per individual, the B2 VIII/O81 clone represented 4% (3 to 7% according to the population) of all isolates and 18% (11 to 28% according to the population) of the B2 strains recovered. By contrast, in a sample of faecal isolates collected in the 1980's from 193 people living in the U.S.A. Mali, Croatia, France and Sweden, the B2 VIII/O81 clone represented only 0.4% of all isolates tested and 4% of the B2 strains. This result suggests that the VIII/O81 clone has increased its representation in human faeces 10-fold in the past twenty years.

To determine if the B2 VIII/O81 clone persists at a high frequency within a host we analysed the dataset cited above, but used all 10 isolates taken from each of the 152 subjects. O81 was detected in 12 of the 152 hosts and, in 42% of these people, the O81 clone represented at least 80% of the *E. coli* isolates recovered from that host. By contrast a non-VIII/O81 B2 strain was detected in 58 hosts, but in these cases the B2 strain represented >80% of the *E. coli* in that host only 17% of the time. Put differently, 77% of the O81 strains detected were found in hosts in which they were the majority clone (>80%), whereas only 37% of non-O81 strains were found in a situation where they represented the majority (>80%) of the *E. coli* in a host. This outcome suggests that the B2 VIII/O81 clone is able to achieve numerical dominance in a human more often than other group B2 strains.

Analysis of Strains from Septicaemic Patients 161 strains obtained from *E. coli* septicaemia episodes were collected and studied (Jauréguy et al., 2007). Eighty strains belonged to the B2 phylogenetic group, but none of them to the B2 VIII/O81 clone.

Moreover, analysis of 1029 *E. coli* septicaemia strains collected in 2005 in the clinical protocol Colibafi (http://www.colibafi.net) shows an absence of strains belonging to the B2 VIII/O81 clone among the 532 strains of B2 phylogenetic group. According to the frequency of this clone in B2 commensal strains (18%), 14 and 96 would have been expected in the two collections, respectively.

Survival in Water

A human specific strain of *E. coli* could be a useful marker in microbial source tracking studies that attempt to determine if human faecal contamination of a water body is occurring. Consequently, we tested the survival of ED1a and compared it to the survival of *E. coli* K12 (Bogosian et al., 1996). In non-sterile river water at 20° C. the decline in viable cell counts of both strains are identical, and by day 9 neither strain can be detected (FIG. 2A). This result is in accordance with previously reported outcomes for K12 (Bogosian et al., 1996). In sterile river water at 20° C., viable cell counts of both strains declined by only 1 to 2 log in 35 days, with ED1a exhibiting poorer survival than K12 (FIG. 2B). These findings are consistent with earlier suggestions that the decline of *E. coli* populations in water is due to predation by protozoa, phages and exposure to heat-labile toxins.

Discussion

Host-specific *E. coli* pathogens are not unknown, for example it has long been thought that *Shigella* strains are primate specific (Donnenberg 2002) and there are rabbit specific enteropathogenic *E. coli* (Leyton et al., 2007). However, this is the first report of what is apparently a human-host specific commensal strain of *E. coli*. This clone belongs to the B2 phylogenetic group and, although B2 strains are often responsible for extra-intestinal infection (Picard et al., 1999), strains of this clone appear to rarely cause disease. The B2 VIII/O81 clone is absent from the Acthman *E. coli* MLST database and over half of the 1400 isolates in this database are listed as pathogens (Wirth et al., 2006). Based on its virulence determinant pattern and/or serotype, this clone is also absent from European and American collections of B2 strains responsible for newborn meningitis (n=99, Bonacorsi et al., 2003) and urosepsis (n=108, Bingen-Bidois et al., 2002; Johnson and Stell, 2000). Finally, none of the strains of this clone is virulent in the mouse model of extra-intestinal infection.

B2 VIII/O81 clone appears to be highly successful as it has been found on three continents and, in some populations, it can represent up to 7% of the isolates taken from human faeces. The reason for the absence of this clone in humans living in Australia is unknown. Geographic isolation is unlikely to be the answer, as over 60% of the MLST sequence types isolated from Australian humans have been detected in other parts of the world (unpublished data). All isolates of the B2 VIII clone with an O81 serotype are also very homogeneous in terms of the possessing a very similar suit of genes, that in other B2 strains have a highly polymorphic distribution and this observation is consistent with the idea that the clone has undergone a recent expansion.

The existence of a human-specific *E. coli* clone has immediate applied applications:

The B2 VIII/O81 clone can be used as a probiotic, as it appears to be avirulent and good coloniser of the human gut. The avirulent nature of this strain means that it might be particularly appropriate for use in highly vulnerable patients, such as those in intensive care, the immunocomprised, or premature infants. By comparison the currently used probiotic strains, Nissle O6 strain (Mutaflor®) isolated in 1917 from the faeces of a healthy soldier (Sun et al., 2005) and the A0 34/86 O83 strain isolated from porcine faeces (Hejnova, et al., 2005), are highly virulent in our mouse model of extra-intestinal virulence (killing 10 and 9 mice out of 10 inoculated, respectively).

Microbial source tracking is another application of the O81/B2 subgroup VIII clone. The usefulness of the microbial indicators as tool risk assessment can be significantly enhanced by the use of a human specific clone. The fact that all the individuals do not carry the O81/B2 subgroup VIII clone is not a problem as human faecal pollution is generally due to release of sewage from wastewater treatment plants or septic tanks, and therefore represents faecal contamination not by individuals but by populations. The absence of growth in water makes the B2 subgroup VIII/O81 clone a good marker of human faecal contamination of water. Furthermore, the PCR assay that we have developed can be used to identify the clone directly from water or soil samples.

CONCLUSIONS

*Escherichia coli* is a widespread commensal of the intestinal tract of humans and other vertebrates that occasionally causes intestinal and extra-intestinal diseases. Up to now, no strong association between a particular clone and a given host species has been found. By screening with a PCR based assay a panel of 723 commensal and clinical human as well as 904 faecal animal strains from four continents, we have identified a human specific clone of O81 serotype belonging to the B2 subgroup VIII as determined by multi-locus sequence typing. Members of this clone are widespread in Africa, Europe and America but not in Australia, almost always isolated in commensal conditions and increase in frequency during the past twenty years. They are able to achieve numerical dominance within a single host, are avirulent in a mouse model of extraintestinal virulence and survive but do not grow in water. They thus can be used as probiotic or for microbiological source tracking of water faecal contamination.

REFERENCES

Throughout this application, various references describe the state of the art to which this invention pertains. The disclosures of these references are hereby incorporated by reference into the present disclosure.

Barnes, B. and D. Gordon. 2004. Coliform dynamics and the implications for source tracking. Environ Microbiol 6: 501-509.

Bingen-Bidois, M., O. Clermont, S. Bonacorsi, M. Terki, N. Brahimi, C. Loukil, D. Barraud, and E. Bingen. 2002. Phylogenetic analysis and prevalence of urosepsis strains of *Escherichia coli* bearing pathogenicity island-like domains. Infect Immun 70: 3216-3236.

Blanco, J. E., M. Blanco, A. Mora, and J. Blanco. 1997. Production of toxins (enterotoxins, verotoxins, and necrotoxins) and colicins by *Escherichia coli* strains isolated from septicemic and healthy chickens: relationship with in vivo pathogenicity. J Clin Microbiol 35: 2953-2957.

Bogosian, G., L. E. Sammons, P. J. L. Morris, J. P. O'Neil, M. A. Heitkamp, and D. B. Weber. 1996. Death of the *Escherichia coli* K-12 strain W3110 in soil and water. Appl Environ Microbiol 62: 4114-4120.

Bonacorsi, S., O. Clermont, V. Houdouin, C. Corevant, N. Brahimi, A. Marecat, C. Tinsley, X. Nassif, M. Lange, and E. Bingen. 2003. Molecular analysis and experimental virulence of Fraench and North American *Escherichia coli* neonatal meningitis isolates: identification of a new virulent clone. J Infect Dis 187: 1895-1906.

Clermont, O., J. R. Johnson, M. Menard, and E. Denamur. 2007. Determination of *Escherichia coli* O types by allele-specific polymerase chain reaction: application to the O types involved in human septicemia. Diagn Microbiol Infect Dis 57: 129-156.

Donnenberg, M. 2002. *Escherichia coli* virulence mechanisms of versatile pathogen. Elsevier Science Ed ed, San Diego Calif.

Duriez, P., O. Clermont, S. Bonacorsi, E. Bingen, A. Chaventre, J. Elion, B. Picard, and E. Denamur. 2001. Commensal *Escherichia coli* isolates are phylogenetically distributed among geographically distinct human populations. Microbiology 147: 1671-1676.

Escobar-Páramo, P., O. Clermont, A. Blanc-Potard, D. Bui, C. Le Bouguenec, and E. Denamur. 2004a. A specific genetic background is required for acquisition and expression of virulence factors in *Escherichia coli*. Mol Biol Evol 21: 1085-1094.

Escobar-Páramo, P., K. Grenet, A. Le Menach, L. Rode, E. Salgado, C. Amorin, S. Gouriou, B. Picard, M. Cherif Rahimy, A. Andremont, E. Denamur, and R. Ruimy. 2004b. Large-scale population structure of human commensal *Escherichia coli* isolates. Appl Environ Microbiol 70: 5698-5700.

Escobar-Páramo, P., A. Sabbagh, P. Darlu, O. Pradillon, C. Vaury, E. Denamur, and G. Lecointre. 2004c. Decreasing the effects of horizontal gene transfer on bacterial phylogeny: the *Escherichia coli* case study. Mol Phyl Evol 30: 243-250.

Escobar-Páramo, P., A. Le Menac'h, T. Le Gall, C. Amorin, S. Gouriou, B. Picard, D. Skurnik, and E. Denamur. 2006. Identification of forces shaping the commensal *Escherichia coli* genetic structure by comparing animal and human isolates. Environ Microbiol 8: 1975-1984.

Gerdes, S. Y., M. D. Scholle, J. W. Campbell, G. Balazsi, E. Ravasz, M. D. Daugherty, A. L. Somera, N. C. Kyrpides, I. Anderson, M. S. Gelfand, A. Bhattacharya, V. Kapatral, M. D'Souza, M. V. Baev. Y. Grechkin, F. Mseeh, M. Y. Fonstein, R. Overbeek, A. L. Barabasi, Z. N. Oltvai, and A. L. Osterman. 2003. Experimental determination and system level analysis of essential genes in *Escherichia coli* MG1655. J Bacteriol 185: 5673-5684.

Gordon, D. M. 2001. Geographical structure and host specificity in bacteria and the implications for tracing the source of coliform contamination. Microbiology 147: 1079-85.

Gordon, D. M., and A. Cowling. 2003. The distribution and genetic structure of *Escherichia coli* in Australian vertebrates: host and geographic effects. Microbiology 149: 3575-3586.

Gordon, D. M., S. E. Stern, and P. J. Collignon. 2005. Influence of the age and sex of human hosts on the distribution of *Escherichia coli* ECOR groups and virulence traits. Microbiology 151: 15-23.

Gordon, D. M., and C. L. O'Brien. 2006. Bacteriocin diversity and the frequency of multiple bacteriocin production in *Escherichia coli*. Microbiology 152: 3239-44.

Harms, H., Wells M. C., and van der Meer J. R. 2006. Whole-cell living biosensors—are they ready for environmental application? Appl Microbiol Biotechnol 70: 273-280.

Hejnova, J., U. Dobrindt. R. Nemcova, C. Rusniok, A. Bomba, L. Frangeul, J. Hacker, P. Sebo, and C. Buchrieser. 2005. Characterization of the flexible genome complement of the commensal *Escherichia coli* strain A0 34/86 (O83: K24: H31). Microbiology 151: 385-398.

Herzer, P. J., S. Inouye, M. Inouye, and T. S. Whittam. 1990. Phylogenetic distribution of branched RNA-linked multicopy single-stranded DNA among natural isolates of *Escherichia coli*. J Bacteriol 172: 6175-6181.

Jauréguy, E. Carbonnelle, S. Bonacorsi, C. Clec'h, P. Casassus, E. Bingen, B. Picard, X. Nassif, O. Lortholary, 2007. Host and bacterial determinants of initial severity and outcome of *Escherichia coli* sepsis. Clinical Microbiology and Infection, 13: 854-862.

Johnson, J. R., and A. L. Stell. 2000. Extended virulence genotypes of *Escherichia coli* strains from patients with urosepsis in relation to phylogeny and host compromise. J Infect Dis 181: 261-272.

Johnson, J. R., O. Clermont, M. Menard, M. A. Kuskowski, B. Picard, and E. Denamur. 2006. Experimental mouse lethality of *Escherichia coli* isolates, in relation to accessory traits, phylogenetic group, and ecological source. J Infect Dis 194: 141-1150.

Karlin and Altschul 1990. Methods for assessing the statistical significance of molecular sequence features by using general scoring schemes. Proc. Natl. Acad. Sci. USA 87: 2264).

Karlin and Altschul 1993. Applications and statistics for multiple high-scoring segments in molecular sequences. Proc. Natl. Acad. Sci. USA 90: 5873-5877.

Leyton, D. L., L. M. Adams, M. Kelly, J. Sloan, M. Tauschek, R. M. Robins-Browne, and E. L. Hartland. 2007 Contribution of a novel gene rpeA encoding a putative autotransporter adhesin to intestinal colonization by rabbit enteropathogenic *Escherichia coli*. Infect Immun doi: 10.1128/IAI.00972-06

Myers and Miller, 1988. Optimal alignments in linear space. Comput Appl Biosci 4: 11-17.

Nataro and Kaper, 1998. Diarrheagenic *Escherichia coli*. Clin. Microbiol. Rev. 1998 11: 142-201

Needleman and Wunsch 1970. A general method applicable to the search for similarities in the amino acid sequence of two proteins. J. Mol. Biol. 48: 443-453.

Ochman, H. and R. K. Selander. 1984. Standard reference strains of *Escherichia coli* from natural populations. J Bacteriol 157: 690-693.

Pearson and Lipman 1988. Improved tools for biological sequence comparison. Proc. Natl. Acad. ScL 85: 2444-2448.

Picard, B., J. Garcia, S. Gouriou, P. Duriez, N. Brahimi, E. Bingen, J. Elion, and E. Denamur 1999. The link between phylogeny and virulence in *Escherichia coli* extraintestinal infection. Infect Immun 67: 546-553.

Power M L, Littlefield-Wyer J, Gordon D M, Veal D A, Slade M B. 2005. Phenotypic and genotypic characterization of encapsulated *Escherichia coli* isolated from blooms in two Australian lakes. Environ Microbiol. 7 (5): 631-40.

Scott, T. M., J. B. Rose, T. M. Jenkins, S. R. Farrah, and J. Lukasik. 2002. Microbial source tracking: current methodology and future directions. Appl Environ Microbiol 68: 5796-5803.

Smith et al. 1981. Comparative biosequence metrics. Adv. Appl. Math. 2: 482.

Souza V, M. Rocha, A. Valera, and L. E. Eguiarte. 1999. Genetic structure of natural populations of *Escherichia coli* in wild hosts on different continents. Appl Environ Microbiol 65: 3373-3385.

Sun, J., F. Gunzer, A. M. Westendorf, J. Buer, M. Scharfe, M. Jarek, F. Gössling, H. Blöcker, and A. P. Zeng. 2005. Genomic peculiarity of coding sequences and metabolic potential of probiotic *Escherichia coli* strain Nissle 1917 inferred from raw genome data. J Biothechnol 117: 147-161.

Vassaux, G., J. Nitcheu, S. Jezzard, and N. R. Lemoine. 2006. Bacterial gene therapy strategies. J Pathol 208: 290-8.

Wirth, T., D. Falush, R. Lan, F. Colles, P. Mensa, L. H. Wieler, H. Karch, P. R. Reeves, M. C. Maiden, H. Ochman, and M. Achtman. 2006. Sex and virulence in *Escherichia coli*: an evolutionary perspective. Mol Microbiol 60: 1136-1151.

SEQUENCE LISTING (12 sequences)

SEQ ID NO: 1 - DNA, 727 bp, Escherichia coli
ttgaaggagcgcaaagaaggcgcattcattcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgaggtgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgcctaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagcagcgattgatgcaggagctgcgggcgcgatttctggttcggccatcgttaaaatcatcgagcaacatattaatgagccagagaaaatgctgg

SEQ ID NO: 2 - DNA, 1138 bp, Escherichia coli
tttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtactcggtcaggctttactggcgaagcggatgggtaaaactgaaattattgccgaaaccggtgccggtcagcatggcgtggcgtcggcccttgccagcgccctgctcggcctgaaatgccgtatttatatgggtgccaaagacgttgaacgccagtcgcctaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttc

SEQ ID NO: 3 - DNA, 1003 bp, Escherichia coli
ccatatagccgctttgatattgtggtcgccgagccgatttgcactttaaccactttcggtaaagaaaccgttgttagtgaaagcgaaaaacgcacaacgaccactgatgacccgctacaggtgctccagcaggtgctggatcgcgcagacattcgcccagcgcataacgaagatttgccatttcagggcggcgcgctggggttgtttggctacgatctgggccgccgttttgagtcactgccagaaattgcgcagcaagatatcgttctgccggatatggcagtgggtatctacgactgggcgctggttgtcgaccaccagcgtcaaacagtttctttgctgagtcataatgatgtcaatgcccgtcgggcctggctggaaagccagcaattctcgccgcaggaagatttcacgctcacttccgactggcaatccaatatgacccgcgagcagtacggcgaaaaatttcgccaggtacaggaatatctgcacagcggtgattgctatcaggtgaatctcgcccagcgttttcatgcgacctattctggcgatgaatggcaggcattccttcagcttaatcaggccaaccgcgcgccgtttagcgcttttttacgccttgagcagggcgcgattttaagcctttcaccagagcggtttatcctttgtgataatagtgaaatccagacccgcccgattaaaggcacgctaccacgcctgcccgatcctcaggaagatagcaaacaagcagagaaactggcgaactcagcgaaagatcgtgccgaaaatctgatgattgtcgatttaatgcgtaatgatatcggtcgtgttgccgtagcaggttcggtaaaagtaccagagctcttcgtggtggaacccttccctgccgtgcatcatctggtcagcaccataacggcgcaactaccagaacagttacacgccagcgatctgttgcgcgcggcttttcctggtggctcaataaccggggcaccgaaagtacgggcta

SEQ ID NO: 4 - DNA, 906 bp, Escherichia coli
ctcgcggtgagctggactgacactgtacaggccagtctgatgatttttgccctgatcctgacgccagttatcgtcattatcagtgtcggtggctttggtgactcgctggaagtaatcaaacaaaagagcattgaaaacgtggatatgctcaaagggttgaattttgtcgccattatctcgctgatgggttgggggctgggttacttcgggcagccgcacatcctggcgcgttttatggcggcagattctcaccacagcattgtccatgcgcgtcgtattagtatgacctggatgatcctctgcctggcaggggcggtggctgtcggcttctttggtatcgcttactttaacgagcacccggcggtagcaggtgcggtaaaccagaacgccgagcgcgtgtttattgaactggcacaaattctgtttaacccgtggattgccgggattttgctgtcggcgattctggcggcggtaatgtcaacgttaagttgccagctgctggtatgttccagtgcgattaccgaagatttatacaaagcgtttctgcgtaaacaggccagccagaaagagctggtgtgggtagggcgagtgatggtgctggtggtggcgctggtggcgattgcgctggcggcaaacccggaaaaccgcgtgctgggcttagtgagctacgcgtgggcaggctttggcgcagcgtttggtccggtggtgctgttctcggtgatgtggtcacgcatgacgcgcaacagtgcgctggcggggatgatcatcggtgcgctgacggttatcgtctggaaacagttcggctggctgggtctgtacgaaattattccgggctttatcttcggcagtatcgggattgtagtgtttagtttgctgggtaaagcgccgtcagcggcgatgcaaaaa

SEQ ID NO: 5 - DNA, 1166 bp, Escherichia coli
accctgcaaaacggcaaactcaacgttcctgaaaatccgattatcccttacattgaaggtgatggaatcggtgtagatgtaaccccagccatgctgaaagtggtcgacgctgcagttgagaaagcctataaaggcgagcgtaaaatctcctggatggaaatttacaccggtgaaaaatccacacaggtttatggtcaggacgtctggttgcctgctgaaacccttgatctgattcgtgaatatcgcgttgccattaaaggcccgctgaccactccggttggtggcggtattcgctctctgaacgttgccctgcgccaggaactggatctctacatctgcctgcgtccggtacgttactatcagggcactccaagcccggttaaacaccctgaactgaccgatatggttatcttccgtgaaaactcggaagacatttatgcgggtatcgaatggaaagcagactctgccgacgctgagaaagtgattaaattcctgcgtgaagagatgggcgtgaagaaaattcgcttcccggaacattgcggtatcggtattaagccgtgttcggaagaaggcaccaaacgtctggttcgtgcagcgatcgaatacgcaattgctaacgatcgtgactctgtgaccctggtgcacaaaggcaacatcatgaagttcaccgaaggcgcgtttaaagactggggctaccaactggcgcgtgaagaatttggcggtgaactgatcgacggcggcccgtggctgaaagttaaaaacccgaataccggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggtggtatcggtatcgcccctggcgcaaacatcggtgacgaatgcgccctgtttgaagccacccacggtactgcgccgaaatatgccggacaggacaaagtaaacccaggctctattattctctccgctgagatgatgctgcgccacatgggttggactgaagccgcagacctgattgttaaaggtatggaaggcgcaatcaatgcgaagaccgtaacctatgacttcgaacgtctgatggaaggcgctaaactgct

SEQ ID NO: 6 - DNA, 1081 bp, Escherichia coli
agcgttaccgtattccgctgcgtctggggcgtgataacagcgagttggagtggcgcgagcacggctttaaaaacggcgtcttttttgctcaggccaaagggcgactgattatcgacggtatcgaggcgctgaaatccgcgttctggaatttctcttcattctcgctggaaaccgtcgctcaggagttattaggcgaaggaaaatctatcgataacccgtgggatcgaatggacgaaattgaccgccgtttcgccgaagataagcctgcgctggcaacttataacctgaaagattgcgagctggtgacgcagatcttccacaaaactgaaatcatgccgtttttgctcgaacgggcgacggtgaacggcctgccggtagatcgacacggcggttcggtggcagcgtttggtcatctctattttccccgtatgcatcgcgctggttatgtcgcgcctaatctcggcgaagtgccgccgcacgccagccctggcggctacgtgatggattcgcgacctgggctttatgattcggtgctggtgctggactacaaaagcctgtacccgtcgatcatccgcacctttctgattgatcccgtcggactggtggaaggcatggcgcagcctgatccagagcacagtaccgaaggttttctcgatgcctggttctcacgggagaaacattgcctgccggagattgtgactaacatctggcacgggcgcgatgaagccaaacgtcagagtaataagccgctttcgcaggcgctgaagatcattatgaatgccttttatggtgtgctcggcaccaccgcctgccgtttcttcgatccacgcctggcatcgtcgatcaccatgcgtggtcatcagatcatgcggcaaaccaaaacgttgattgaagcgcagggctatgatgttatctacggcgataccgactcaacgtttgtctggctgaaaggtgcacattcggaagaagaagcagcgaaaatcggtcgtgcactggtgcagcacgttaacgcctggtgggcggaaacgctgcaaaaacaacggctgaccagcgcactggaactggagtatgaaacccattt

SEQ ID NO: 7 - DNA, 5092707 bp, Escherichia coli (residues 1-1,697,569 of 5,092,707)
  misc_feature (1412423)..(1412522): n is a, c, g, or t
  misc_feature (1638195)..(1638294): n is a, c, g, or t
  misc_feature (1959934)..(1960387): n is a, c, g, or t
  misc_feature (2351498)..(2351597): n is a, c, g, or t
ttttttttcgaccaaaggtaacgaggtaacaaccatgcgagtgttgaagttcggcggtacatcagtggcaaatgcagaacgttttctgcgggttgccgatattctggaaagcaatgccaggcaggggcaggtggccaccgtcctctctgcccccgccaaaatcaccaaccatctggtagcgatgattgaaaaaaccattagcggccaggatgctttacccaatatcagcgatgccgaacgtatttttgccgaacttctgacgggactcgccgccgcccagccgggatttccgctggcacaattgaaaactttcgtcgaccaggaatttgcccaaataaaacatgtcctgcatggcatcagtttgttggggcagtgcccggatagcatcaacgctgcgctgatttgccgtggcgagaaaatgtcgatcgccattatggccggcgtgttagaagcgcgtggtcacaacgttaccgttatcgatccggtcgaaaaactgctggcagtgggtcattacctcgaatctaccgttgatattgctgaatccacccgccgtattgcggcaagccgcattccggctgaccacatggtgctgatggctggtttcactgccggtaatgaaaaaggcgagctggtggttctgggacgcaacggttccgactactccgctgcggtgctggcggcctgtttacgcgccgattgttgcgagatctggacggatgttgacggtgtttatacctgcgatccgcgtcaggtgcccgatgcgaggttgttgaagtcgatgtcctatcaggaagcgatggagctttcttacttcggcgctaaagttcttcacccccgcaccattacccccatcgcccagttccagatcccttgcctgattaaaaataccggaaatccccaagcaccaggtacgctcattggtgccagccgtgatgaagacgaattaccggtcaagggcatttccaatctgaataacatggcaatgttcagcgtttccggcccggggatgaaagggatggttggcatggcggcgcgcgtctttgcagcgatgtcacgcgcccgtatttccgtggtgctgattacgcaatcatcttccgaatacagtatcagtttctgcgttccgcaaagcgactgtgtgcgagctgaacgggcaatgcaggaagagttctacctggaactgaaagaaggcttactggagccgttggcggtgacggaacggctggccattatctcggtggtaggtgatggtatgcgcaccttacgtgggatctcggcgaaattctttgccgcgctggcccgcgccaatatcaacattgtcgccattgctcagggatcttctgaacgctcaatctctgtcgtggtcaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggttgaagaataaacatatcgacttacgtgtctgcggtgttgctaactcgaaggcactgctcaccaatgtacatggccttaatctggaaaactggcaggaagaactggcgcaagccaaagagccgtttaatctcgggcgcttaattcgcctcgtgaaagaatatcatctgctgaacccggtcattgttgactgtacttccagccaggctgtggcagatcaatatgccgacttcctgcgcgaaggtttccacgttgttacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgctggtgatgaattgatgaagttctccggcattctttcaggttcgctttcttatatcttcggcaagttagacgaaggcatgattttctccgaggcgaccacactggcgcgggaaatgggttataccgaaccggacccgcgagatgatctttctggtatggatgtggcgcgtaagctattgattctcgctcgtgaaacgggacgtgaactggagctggcggatattgaaattgaacctgtgctgcccgcagagtttaacgccgagggtgatgtcgccgcttttatggcgaatctgtcacagctcgacgatctctttgccgcgcgtgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctgacatggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagagccacgggaaaatatcgtttatcagtgctgggagcgtttttgccaggagcttggcaagcaaattccagtggcgatgactctggaaaagaatatgccgatcggttcgggcttaggctccagcgcctgttcagtggtcgcggcgctgatggcgatgaatgaacactgcggcaagctgcttaatgacactcgtttgctggctttgatgggcgagttggaagggcgtatctccggcagcattcattacgacaacgtggcaccgtgttttcttggtggtatgcagttgatgatcgaagaaaacgacatcatcagccagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggttgcggaaatcggcgcggtagcgagcggtatctccggctccggcccgactttgttcgctctgtgtgacaagccggataccgcccagcgcgttgccgactggttgggtaagaactacctgcaaaatcaggaaggttttgttcatatttgccggctggatacggcgggcgcacgagtactggaaaactaaatgaaactctacaatctgaaagatcacaatgagcaggtcagctttgcgcaagccgtaacccaggggttaggcaaaaatcaggggctgttttttccgcacgacctgccggaattcagcctgactgaaattgatgagatgctgaagctggattttgtcacccgcagtgcgaagatcctctcggcgtttattggtgatgaaatcccgcaggaaatcctggaagagcgcgtacgtgcggcgtttgccttcccggctccggtcgccaatgttgaaagcgatgtcggttgtctggaattgttccacgggccaacgctggcatttaaagatttcggcggtcgctttatggcacaaatgctgacccatattgcgggcgataagccagtgaccattctgaccgcgacatccggtgatactggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctggggctgaattctgctaactccatcaacatcagtcgcttgctggcgcagatttgttattactttgaggctgtcgcacagttgccgcaagaagcacgtaaccagttggttgtctcggtaccgagtggaaacttcggcgatttgacggcgggtctgctggcgaagtcactcggtctgccggtaaaacgttttattgctgcgaccaacgtgaacgataccgtaccacgtttcctgcacgacggtcagtggtcacccaaagcgactcaggcgacgttatccaatgcgatggatgttagccagccaaacaactggccgcgtgtggaagagttgttccgccgcaaaatctggcaactgaaagagctgggttatgcagccgtggatgatgaaaccacgcaacagacaatgcgtgagttaaaagaactgggctatacctcggagccgcacgctgccgtagcgtatcgtgcgctgcgtgaccagttgaatccaggcgaatatggcttgttcctcggcaccgcgcatccggcgaaatttaaagagagcgtggaagcgattctcggtgaaacgttggatctgccaaaagagctggtagaacgtgctgatttacccttgctttcgcataacctgcccgccgattttgctgcgttgcgtaaattgatgatgaatcatcagtaacgtctattcattatctcaatcaggccgggtttgcttttatgcagcccggcttttttatgaagaaaatatggagaaaaacgacagggaaaaaggagaaattctcaataaatgcggtaacttagagattaggattgcggagaataacaactgccgttctcatcgcgtaatctccggatatcgacccataacgggcaatgataaaaggagtaacctgtgaaaaagatgcaatctatcgtactcgcactttccctggttctggtcgctcccatggcagcgcaggctgcggaaattacgctagtcccgtcagtaaaattacagataggcgatcgtgataatcgtggctattactgggatggcggtcactggcgcgaccacggctggtggaaacaacattatgaatggcgaggcaatcgctggcacccatatggaccgccgccatcgccgcgccataacaagcacaatgatcatcgtggcgatcatcgtccggggcctgacaaacatcatcgctaaatatcaatgccggattgccatccggcattatccggcattgactacaaacttaacgttgttcgtagcgtttaaacaccagttcgccattgctggaggaagcttcatcaaagaagtaaccttcgctattaaaaccagtcagttgctctggtttggtcagccgattttcaataatgaaacgactcatcagaccgcgtgctttcttagcgtagaagctgattatcttaaatttgccgttcttctcatcgaggaacactggtttgataatctcggcattcaatttcttcggcttcaccgatttaaaatactcatctgacgccagatttatcactacattatcgccttgtgctgcgagcgcctcgttcagcttgttggtgatgatatctccccagaattgatacagatctttccctcgggcattctcaagacgtatccccatttccagacgataaggctgcattaaatcgagcgggcgcagtacgccatacaagccggaaagcattcgcaaatgctgttgggcaaaatcgaaatcgtcttcgctgaaggtttcggcctgcaagccagtgtagacatcacctttaaacgccagaattgcctggcgggcattctccggtgtgaaatctggctgccagtcatgaaagcgagcggcgttgatacccgccagtttgtcgctgatgcgcatcagggagctaatctgcgggggcgtcagtttccgcgcttcatggatcagctgctgggagttgtctaacagctccggcagcgtatagcgcgtggtggtcaacgggctttggtaatcaagcgttttcgcaggtgaaataagaatcagcatatccagtccttgcaggaaatttatgccgactttagcaaaaaaagagaatgagttgatcgatagttgtgattactcctgcgaaacatcatcccacgcgtctggagaaagctggcgaccgatctccggataacgcaacggataaaacaccgggcgcacgccgagtttacgctggcgtagataatcactggcaatggtatgaaccacaggcgagagcagtaatatggcggtcaaattggtaatagtcatgcaggccataatgatatctgccagttgccacatcagcggaaaacttagcaaggtgccgccgatgaccgttgcgaaggtgcagatccgcagacaccagatcgctttagggttgttcaggcgtaaaaagaagagattgttttcggcataaatgtagttggcaacgatggagctgaaggcaaacagaataaccacgagggtaacaaactccgcaccccaggaacccattagcacccgcatcgccttctggataagctgaataccttccagcggcatgtaggttgtgccgttacccgccagtaatatcagcatggcgcttgccgtgcagatgaccagggtgtcgataaaaatgccaatcatctggacaattccttgcgctgccggatgcggaggccaggacgcagctgccgctgccgcgtttggcgtcgaccccattcccgcctcattggaaaacatactgcgctgaaaaccgttagtaatcgcctggcttaaggtatatcccgccgcgccgcctgcagcttcctgccagccaaaagcactctcaaaaatagaccaaatgacgtggggaagttgcccgatattcattacgcaaatcaccaggcaggtcagtacccagattatcgccatcaacgggacaaacccctgcatgagccgggcgacgccatgaagaccgcgagtgatcgccagcatagcaaagacagcgagaataatacctgtcaccagcgggggaaaatcaaaagaaaaactcagggctcgcgcaacggcgttcgcctgaactccgctgaaaattatggcgtaggcgatgagcaaaaagacggcgaacagaacgcccatccagcgcatccccagcccgcgcgccatataccatgccggtccgccacgaaactgcccattggcatcacgttctttataaagctgtgcgagggaacattcggcaaacgaggtcgccatgccgataaatgcggcaacccacatccagaagacggctccaggtccaccggcggtaattgccagcgcaacgccggccaggttgccgctacccacgcgcgctgcaagactggtacacaatgactgaaatgaggttaaaccgcctggctgtggatgaatgctatttttaagacttttgccaaactggcggatgtagcgaaactgcacaaatccggtgcgaaaagtgaaccaacaacctgcgccgaagagcaggtaaatcattaccgatccccaaaggacgctgttaataaaggagaaaaaatctggcatgcatatccctcttattgccggtcgcgatgactttcctgtgtaaacgttaccaattgtttaagaagtatatacgctacgaggtacttgataacttctgcgtagcatacatgaggttttgtataaaaatggcgggcgatatcaacgcagtgtcagaaatccgaaacagtctcgcctggcgataaccgtcttgtcggcggttgcgctgacgttgcgtcgtgatatcatcagggcagaccggttacatccccctaacaagctgtttaaagagaaatactatcatgacggacaaattgacctcccttcgtcagtacaccaccgtagtggccgacactggggacatcgcggcaatgaagctgtatcaaccgcaggatgccacaaccaacccttctctcattcttaacgcagcgcagattccggaataccgtaagttgattgatgatgctgtcgcctgggcgaaacagcagagcaacgatcgcgcgcagcagatcgtggacgcgaccgacaaactggccgtaaatattggtctggaaatcctgaaactggttccgggccgtatctcaactgaagttgatgcgcgtctttcctatgacaccgaagcgtcaattgcgaaagcaaaacgcctgatcaaactctacaacgatgcaggtattagcaacgatcgtattctgatcaaactggcttctacctggcagggtatccgtgctgcggaacagctggaaaaagaaggcatcaactgtaacctgaccctgctgttctccttcgctcaggctcgtgcttgtgcggaagcgggcgtgttcctgatctcgccgtttgttggccgtattcttgactggtacaaagcgaataccgataagaaagagtacgctccggcagaagatccgggcgtggtttctgtatctgaaatctaccagtactacaaagagcatggttatgaaaccgtggttatgggcgcaagcttccgtaacatcggcgaaattctggaactggcaggctgcgaccgtctgaccatcgcaccggcactgctgaaagagctggcggaaagcgaaggggctatcgaacgtaaactgtcttacactggtgaagtgaaagcgcgtccggcgcgtatcactgagtccgagttcctgtggcagcacaaccaggatccaatggcagtagataaactggcggaaggtatccgtaagtttgctgttgaccaggaaaaactggaaaaaatgatcggcgatctgctgtaatcatacttagcgtgaccgggaagtcggtcacgctacctcttctgaaacctgtctgtcactcccttcgcagtgtatcattctgtttaacgagactgtttaaacggaaaaatcttgatgaatactttacgtattggcttagtttccatctctgatcgcgcatccagcggcgtttatcaggataaaggcatccctgcgctggaagaatggctgacatcggcgctaaccacgccgtttgaactggaaacccgcttaatccccgatgagcaggcgatcatcgagcaaacgttgtgtgagctggtggatgaaatgagttgccatctggtgctcaccacgggcggaactggcccggcgcgtcgtgacgtaacgcccgatgcgacgctggcagtagcggaccgcgagatgccaggctttggtgaacagatgcgccagatcagcctgcattttgtaccaactgcgatcctttcgcgtcaggtgggggtgattcgcaaacaggcgctgatccttaacttacccggtcaaccgaagtctattaaagagacgctggaaggtgtgaaggacgctgagggtaacgttgtggtgcacggtatttttgccagcgtaccgtactgcattcagttgctggaagggccatacgttgaaacggcaccggaagtggttgcagcattcagaccgaagagtgcaagacgcgaagttagcgaataaaaaaatccccccaagcggggggatcagactgatgacaaacgcaaaactgcctgatgcgctacgcttatcaggcctacgatcttcttgcaatatattgaatttgcacgattttgtaggccggataaggcgttcacgccgcatccggcataaacaaagcgcacgttgttaacaatcttatcccttcgagcggggggagcttaacaattagtgagactcaccaatcggcagaacggtgcgaccaaactgctcgttcagcacttcacccatcgccagatagattgcactggcaccgcagataagaccaatccagccggcaaagtggatgatcgcggcgttaccggcaatgttaccgatcgccagcagggcaaacagcacggtcaggctaaagaaaacgaattgcagaacgcgtgcgcctttcagcgtgccgaagaacataaacagcgtaaatatgccccacagacccaggtagacaccaaggaactgtgcatttggcgcatcggtcagccccagtttcggcatcagcagaattgcaaccagcgtcagccagaaagaaccgtaagaggtgaatgcggttaaaccgaaagtgttgccttttttgtactccagcagaccggcaaaaatttgcgcgatgccgccgtagaaaatgcccatggcaagaataataccgtccagagcaaaataacccacgttgtgcaggttaagcagaatggtggtcatgccgaagcccatcaggcccagcggtgccggattagccaacttagtgttgcccataattcctcaaaaatcatcatcgaatgaatggtgaaataatttccctgaataactgtagtgttttcagggcgcggcataataatcagccagtggggcagtgtctacgatcttttgaggggaaaatgaaaattttccccggtttccggtatcagacctgagtggcgctaaccatccggcgcaggcaggcgatttgcagtacggctggaattgtcacgcgataggcactgccgctgaccgctttaaccccatttaatgctgcgcccacagggcctcccagacccgcgccgcgcagcaaaccatgcccaagcacgctcattgctgcgtgggtgcgtaaaatgcgggtcaattggctggaaagcaaatgcgacacaccttttgccaataatttgtctttcatcagcagcggcagcagctcttccagctcattcaccctggcatcgaccgcgtgcagaaactcctgcttatgttcctcgtccattttcttccaggtattacgcagaaattgttccagtaactgttgctcaatttcaaacgtagacatctctttgtcggctttcagcttcaatcgctttgaaacatcgagcaaaatggcgcgatacaatttaccgtgtccgcgcagtttgttggcgatactatcgccaccaaaatgctgtaattctccggcaatcagctgccagttgcggcggtgtcgctcgggatgtccttccatcgatttaaacagttcgttgcgcatcagtacgctggagaggcgagttttgcctttttcattatgggtgagcagccgggcgaaatttgccaactgttcctcactacaatgctggagaaaatccagatctgaatcattcaggtaattaacattcattttttgtggtttctatattctggcgttagtcgtcgccgataattttcagcgtggccatatccgatgagttcactgtatgaccggaaaaggtgatttttgagacgcagcgtttgttgtcgttatcgctgttaatgttgatccagtcagtggtttgctcttcttttatttctgaaggaatattcagggtctgactggcgcttcgggtggctttgaaataaatcgatgcaccgcttaactgcaaatcgccatggtcggctgagagttgtatgcgtttaacaatgcgacaaacaggaagtttcagcgccagatcgttggtttcgtttcgcggcattgcaatgacgccgaggattttatggtcgtttgcctgcgccgtgcagcacagcatcaggctaatcgccaggctggcggaaatcgtaataacggatttcataaggattctcttggtggggaggggtaaggggatgaaactagtttactgctgataaagagaagtttcaggtacgtaatattttctttttattacaattttttgatgaatgccttggctgcgattcattctttatatgaataaaattgttgtcagtttcacgtcttgtcctgccatatcgcgaaatttctgcgcaaaagcacaaaaaatttttgcatctcccccttgatgacgtgggttacgaccccatttagtagtcaaccgcagtgagtgagtctgcaaaaaaatgaaattgggcagttgaaaccagacgtttcgcccctattacagactcacaaccacatgatgaccgaatatatagtggagacgtttagatgggtaaaataattggtatcgacctgggtactaccaactcttgtgtagcgattatggatggcaccactcctcgtgtactggagaacgccgaaggcgatcgcaccacgccttctatcattgcctatacccaggatggtgaaactctggttggtcagccggctaaacgtcaggcagtgacgaacccgcaaaacaccctgtttgcgattaaacgcctgattggccgccgcttccaggacgaagaagtacagcgtgatgtttccatcatgccgttcaaaattattgctgctgataacggcgacgcatgggtcgaagttaaaggccagaaaatggcaccgccgcagatctctgctgaagtgctgaaaaaaatgaagaaaaccgctgaagattacctgggtgaaccggtaactgaagctgttattaccgtaccggcatactttaacgatgctcagcgtcaggcaaccaaagacgcaggccgtatcgctggtctggaagtaaaacgtatcatcaacgaaccgaccgcagctgcgctggcttacggtctggacaaaggtactggcaaccgtactatcgcggtttatgacctgggtggtggtactttcgatatttccattatcgaaatcgacgaagttgacggcgaaaaaaccttcgaagttctggcaaccaacggtgatacccacctgggtggtgaagacttcgacagtcgtctgatcaactatctggttgaagaattcaagaaagatcagggcattgacctgcgcaacgatccgctggcaatgcagcgcctgaaagaagcggcagaaaaagcgaaaatcgaactgtcttccgctcagcagaccgacgttaacctgccgtacatcactgcagacgcgaccggtccgaaacacatgaacatcaaagtgactcgtgcgaaactggaaagcctggttgaagatctggtaaaccgttccattgagccgctgaaagttgcactgcaggacgctggcctgtccgtatctgatatcgacgacgttatcctcgttggtggtcagactcgtatgccaatggttcagaagaaagttgctgaattctttggtaaagagccgcgtaaagatgttaacccggacgaagctgtagccatcggtgctgctgttcagggtggtgttctgactggtgacgtaaaagacgtactgctgctggacgttaccccgctgtctctgggtatcgaaaccatgggcggtgtgatgaccacgctgatcgcgaaaaacaccactatcccgaccaagcacagccaggtgttctctaccgctgaagacaaccagtctgcggtaaccatccatgtgctgcagggtgaacgtaaacgtgcggctgataacaaatctctgggtcagttcaacctggatggtatcaacccggcaccgcgcggcatgccgcagatcgaagttaccttcgatatcgatgctgacggtatcctgcacgtttccgcgaaagacaaaaacagcggtaaagagcagaagatcactatcaaggcttcttctggtctgaacgaagatgaaatccagaaaatggtacgcgacgcagaagctaacgccgaagctgaccgtaagtttgaagagctggtacagactcgcaaccagggcgaccatctgctgcacagcacccgtaagcaggttgaagaagcaggcgacaaactgccggctgacgacaaaactgctatcgagtctgcgctgactgcactggaaactgctctgaaaggtgaagacaaagccgctatcgaagcgaaaatgcaggaactggcacaggtttcccagaaactgatggaaatcgcccagcagcaacatgcccagcagcagactgccggtgctgatgcttctgcaaacaacgcgaaagatgacgatgttgtcgacgctgaatttgaagaagtcaaagacaaaaaataatcgccctataaacgggtaattatactgacacgggcgaaggggaatttcctctccgcccgtgcattcatctaggggcaaatcaaaaaagatggctaagcaagattattacgagattttaggcgtttccaaaacagcggaagagcgtgaaatcaaaaaggcctacaaacgcctggccatgaaataccacccggaccgtaaccagggtgacaaagaggccgaggcgaaatttaaagagatcaaggaagcttatgaagttctgaccgactcgcaaaaacgtgcggcatacgatcagtatggtcatgctgcgtttgagcaaggcggcatgggcggcggcggttttggcggcggcgcagacttcagcgatatttttggtgacgttttcggcgatatttttggcggcggacgtggtcgtcaacgtgcggcgcgcggtgctgatttacgctataacatggagctcaccctcgaagaagctgtacgtggcgtgaccaaagagatccgcattccgactctggaagagtgtgacgtttgccacggtagcggtgcaaaaccaggtacacagccgcagacctgtccgacctgtcatggttctggccaggtgcagatgcgccagggtttctttgccgtgcagcagacctgtccacactgtcagggccgcggtacgctgatcaaagatccgtgcaacaaatgtcatggtcatggtcgtgttgagcgcagcaaaacgctgtccgttaaaatcccggcaggggtggacactggagaccgcatccgtcttgcgggcgaaggtgaagcgggtgaacacggcgcaccggcaggcgatctgtacgttcaggttcaggttaaacagcacccgattttcgagcgtgaaggcaacaacctgtattgcgaagtcccgatcaacttcgctatggcggcgctgggtggtgaaatcgaagtaccgacccttgatggtcgcgtcaaactgaaagtgcctggcgaaacccagaccggtaagctgttccgtatgcgcggtaaaggcgtcaagtctgtccgcggtggcgcacagggtgatttgctatgccgcgttgttgtcgaaacaccggtaggtttgaacgagaagcagaaacagctgctgcaagagctgcaagaaagctttggtggcccaaccggcgagcacaacagcccgcgttcaaagagcttctttgatggcgtgaagaagttttttgacgacctgactcgctaacctccccaaaagcctgcccgtgggcaggccagggtaaaaaccagggtgcgttgaagatatgcgagcacctgtaaagtggcggggatcactccccgccgttgctcttactcggattcgtaagccgtgaaaacagcaacctccgtctggccagttcggatgtgaacctcacagaggtcttttctcgttaccagcgccgccactacggcggtgatacagatgacgatcagggcgacaatcatcgccttatgctgcttcattgctctcttctccttgacctttcggtcagtaagaggcactctacatgtgttctgcatatagggggcctcgggttgatggtaaaatatcactcggggcttttctctatctgccgttcagctaatgcctgagacagacagcctcaagcacccgccgctattatactgcgcttttaattcacttctgttttatcaattctttttctgaagacgcctcgcatttttgcggaataatatttcaatacatcaatttatttaacttaaatatatccaggaattcacaaaaaaaggtgttttcctctatcaaaagtgaatggctaaaggaaattaattattaaaggttactgtaatactatagagagacaaagaaatacgttcagcagccaatgctaagttcatcatgaaaaatgcctataaatcaaagggtgatgtttaaaacagacacattttctgaaacacgatatccctccgcccgttcgcaaaagtaatctgcgatcttcatcacgcttcgatagtcatctttaaatatactggcctggtcattcttaataaaaatgaattgtctggtgtattaattcctatggaatcataaaaacaatgaatggagaacatattatatgtctgccaaaagacgacttcttattgcgtgtaccttgataacagctatctatcattttcctgcatattcttcattagaatataaaggaacctttggttcaataaatgcgggttatgcagactggaatagtggatttgtaaacactcaccgtggtgaagtatggaaagtgactgcggattttggggtaaattttaaagaagcagaattttactcattttatgaaagtaatgtactcaatcatgctgtagcagggagaaatcatacggtttcagcaatgacgcatgtcagactctttgactctgatatgacattctttggcaaaatttatggccaatgggataactcatggggtgacgatctggacatgttttatggattcggttacctcggctggaacggcgagtggggcttttttaaaccgtatattggattgcataatcaatctggtgactacgtatcagctaaatatggtcaaacgaatggttggaatggttatgttgttggctggacagcagtattaccatttacgttatttgacgaaaaatttgttttatctaactggaatgaaatagaactggacaggaacgatgcttacacggagcagcaatttggccggaacgggttaaatggcggtttaactattgcctggaagttctatcctcgctggaaagctagtgtgacgtggcgttatttcgataataagctgggctacgatggctttggcgatcaaatgatttatatgcttggttatgatttctaatttttatcagggaataattatgcagaaaacgttaatggccagtttgatcggccttgcagtttgcacagggaatgcttttagtcctgccttagccgcagaggctaaacaacctaatttagtcattattatggcggatgatttaggttatggcgatttagcaacatatggtcatcagatcgttaaaacacctaatatcgacaggcttgcccaggaaggggtcaaatttactgactactatgcccccgctcctttaagttcaccttcacgcgcagggctattaaccggccggatgccatttcgtactggaattcgctcatggattccttcaggcaaagatgttgccttagggcgtaacgaactcacgattgctaatctactcaaagcgcaagggtacgacacggcaatgatgggtaagctgcatctgaatgcaggcggcgatcgcaccgatcagccacaagcacaagatatgggctttgattactcactggttaatacggcgggctttgttaccgacgccacgctggataacgctaaagaacgcccgcgttatggcatggtttacccgacaggctggctacgtaacgggcaacccactccacgagctgataaaatgagcggtgagtatgtcagttcggaagtcgtcaactggctggataacaaaaaggacagcaagcctttcttcctctatgttgcttttaccgaagtgcatagccccctggcttcgcccaaaaaatacctcgacatgtactcacaatatatgagcgcgtatcagaagcagcatcctgatttattttatggcgactgggcagacaaaccctggcgtggtgtgggggaatattatgccaatatcagctatctggatgcacaggttggaaaagtgctggataaaatcaaagcgatgggtgaagaagataacacaatcgttatttttaccagtgataacggtccggtaacgcgtgaagcgcgcaaagtgtatgagctgaatttggcaggggaaacggatggattacgcggtcgcaaggataacctttgggaaggcggaattcgtgttccagccattattaaatatggtaaacatctaccacagggaatggtttcagatacacccgtttatggtctggactggatgcctactttagcgaaaatgatgaacttcaaattacctacagaccgtactttcgatggtgaatcgctggttcctgttcttgagcaaaaagcattgaaacgcgaaaagccattaattttcgggattgatatgccattccaggatgatccaaccgatgaatgggcgatccgtgatggtgactggaagatgattatcgatcgcaataataaaccgaaatatctctacaatctgaaatctgatcgttatgaaacacttaatctgaacggtaaaaaaacagatattgaaaaacagatgtatggtaagtttttaaaatataaaactgatattgataatgattctctaatgaaagccagaggtgataaaccagaagtggtgacctggggctaacctgataatcataataaatgtaatgtatgccatttagggctatgcccgcctgattcagtgctacgcattgaatcaggttcttttcgcgttgaacaatatcaagatacggctattcgcagggagtggatatgtttaccaacgtaaatgttgattgttgcaaaacaccaggatgtaaaaacctggggttgctgaatagccaggattatgtcgcacagggtaaaaatattttatgccgtgaatgtggttacttgtttccagtgatatctgaacagtcgcttaatatttatcgtaatattgtgaatcactcctggagaggtttgatttgccaatgttcaacttgcggaggcacgtccctcaaaaaatatggatattctgcacaaggccagagaagaatgtattgccatcattgtgagaaaacatttatcactctggaacatgtaattaccataccacgaggagccctgttagcattgatgattgagcaaggggaggcacttgcggatatcagaaagtcattacttcttaacagcactggacttagccgtgaactgttaaaattagcgcgtgaagcaaactataaagaaagtcgacagtgtttcccagcttctgatattaccctgagtacccgcgcttttcgcgtcaagtataatggtagcaataactctctttatgctcttgttaccgcagaagaacaaagcggcagggtggttgccatctcaaccaattactccccatctgccgtagagcaacattatcaatacacatcgaactatgaagagcgtatgtctccagggacgctggcacatcatgtccagcgcaaagagttacttactatgcggcgggataccttgtttgatattgattacggcccggcagttttacatcaaaacgatccgggaatgttggtaaaaccggttcttccggcatatcgtcattttgaactggtcagaatactgaccgatgagcattccaacaacgttcagcattaccttgatcacgaatgctttatattgggcggctgcctgatggctaatttgcagcatattcatcaaggtcgctgccatatttcctttgtcaaagagcgcggtgtggcacccgccaccattgattttccaccgcgattattccttagtggtggggtacgaaataatgtctggcgtgcattttctaaccgcaattattcaatggctgtatgcaatctcactggcagtaagaaagtccgcgagatgcggcatgcaacattgaacagtgcgacgcgttttatccactttgtggagaaccatcctttccttatatcattgaaccgaatgtctcctgcgaatgtcgtttctacattagatatcctcaaacatctgtggaataaaaaactagagcatggaacaatttaattattacttttccgaataatttcttcagaaatcttgacattagactatgattaatggggtttaaggtcatcagccgccgctttcgggcatcaaaaactcatctctcgctgatggcgcaattcttttaatagatcgtaaaaagcgagctattcctacactataatctgattttaacgatgattcgtgcggggtaaaatcgtgaaaacgatctattcacctgaagagaaataaaaagtgaaacatctgcatcgattctttagcagtgatgcctcgggaggcattattctcattattgccgctgtattagcgatgattatggccaacagcggtgcaaccagtggatggtatcacgactttcttgagacgccggttcagctccgggttgggacacttgagatcaacaagaacatgctgctatggatcaatgacgctctgatggcggtatttttcctgttggttggtctggaagttaaacgcgagctgatgcaaggttcgctggccagtctgcgccaggcggcatttcctgttattgccgcaatcggcgggatgattgtcccggcattgctctatctggcttttaactatgccgatccgattacccgcgaaggctgggcaatcccggcggcgactgacattgcctttgcacttggtgtgttggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgtggtattgaatctgtgtggtgtacgccgcacgggcgtttatattctggttggcgtggtgctgtggacagcggtgttgaaatcgggggttcacgcaaccctggcgggcgtcattgtcggcttctttattccgttaaaagagaagcatgggcgttctccagcgaagcgactggagcatgtgttgcacccgtgggtggcgtatctgattttaccgctgtttgcatttgctaatgctggcgtttcactgcaaggcgtcacgctggatggcctgacctccatcctgccattagggatcatcgctggtttgctgattggcaagccactgggtattagtctgttctgctggttggcgctgcgtttgaaattggcacatctgccagagggaacgacttaccagcaaattatggcggttggtatcctgtgcggtatcggttttactatgtctatctttattgccagcctggcatttggtagcgtagatccagaactgattaactgggcaaaattaggtatccttgtcggttcaatttcttcggcggtaattggatatagctggttacgcgttcgtttacgtccatcagtttgacaggacgatgtactggggagccataaacggctcccttttcattgttatcagggagagaaatgagcatgtctcatatcaattacaaccacttgtattacttctggcatgtctacaaagaaggttctgtggttggcgcagcggaggcgctttatttaacaccacaaaccattaccgggcagatccgggcgctggaagagcgcctgcaagggaaactatttaagcgtaaaggacgtggtctggaacccagcgaactgggggaactggtctatcgctatgccgataaaatgttcaccttaagccaggaaatgctggatatcgtcaactatcgcaaagagtccaacttattgtttgatgttggtgtggcagatgcactttccaaacgtctggtcagcagtgttctggatgccgcagttgtggaagacgagcagatccatctacgctgtttcgaatcgacgcacgagatgcttttagagcagttgagtcagcataaactggatatgatcatctctgactgtccgatcgattccactcagcaggaagggctgttttccatgaaaattggcgaatgtggtgtcagtttctggtgcactaacccactaccagaaaagccgtttcctgcctgtcttgaagagcgtcgtttacttattccggggcgtcgctcaatgttggggcgtaaactattaaactggtttaactcccagggcttgaacgtcgaaattttgggtgagtttgatgatgctgcgttgatgaaagcctttggggcgacgcataacgctattttcgttgcaccttcgctttacgctaatgatttctataacgatgactcggttgtggagataggccgtgttgagaacgtgatggaagagtaccacgcgatttttgccgaaaggatgattcagcaccctgcagtacagcgtatctgcaatacagactattctgcgctgtttactccagcttcaaaataaacatttgtactttgcaggccgaattttggcctgcagatggatataaaaaaacccgccagagcgggtttttttacaaagctgacaacaacaggcaattaagccagtttgttgatctgtgcagtcaggttagccttatgacgtgcagctttgtttttgtggatcagacctttagcagcctgacggtccacgattggttgcatttcgttaaatgctttctgtgcagcagctttgtcgccagcttcgatagctgcgtatactttcttgatgaaagtacgcatcatagagcgacggcttgcgttgtgcttacgagccttttcagactgaatggcgcgcttcttagctgatttgatattagccaaggtccaactcccaaatgtgttctatatggacaattcaaaggccgaggaatatgcccttttagccttcttttgtcaatggatttgtgcaaataagcgccgttaatgtgccggcactcgttacgtagtgatggcgcaggattctaccagcttgcggggtgtgaatacagcttttccgcgagaaaaattgcagcaggcggtcagtttcttcccatgatttgcgccatagcaatgaaaagccacttctttctgatttcggtactcaatcgccggttaaccttgaccgctgtacaaggtatactcggacgattttcactgttttgagccagacatgaagctgatacgcggcatacataatctcagccaggccccgcaagaagggtgtgtgctgactattggtaatttcgacggcgtgcatcgcggtcatcgcgcgctgttacagggcttgcaggaagaagggcgcaagcgcaacttaccggtgatggtgatgctttttgaacctcaaccactggaactgtttgctactgataaagccccggcacggctcacccggctgcgggaaaaactgcgttatcttgcagagtgtggcgttgattacgtgctgtgcgtgcgttttgacaggcgttttgcggcgttaaccgcgcaaaacttcatcagtgatcttctggtgaagcacttgcgggtaaaatttcttgccgtaggtgacgatttccgctttggcgctggtcgtgaaggcgatttcttgttattacagaaagcgggcatggaatacggcttcgatatcaccagcacgcaaactttttgcgaaggtggcgtgcgtatcagcagcaccgccgtgcgtcaggcgcttgcggatgacaatctggctctggcagaaagtttactggggcacccgtttgctatctccgggcgtgtagtccacggtgatgaattagggcgcactataggtttcccgacggcgaatgtaccgctacgccgtcaggtttccccggtgaaaggggtttatgcggtagaagtgttgggccttggcgaaaagccgttacccggcgttgcaaacatcggaacacgcccaacggttgccggtattcgccagcaactggaagtgcatttgttagatgttgcaatggacctttatggtcgccatatacaagtagtgctgcgtaaaaaaatacgcaatgagcagcgatttgcatcgctggacgaactgaaagcgcagattgcgcgtgatgaattaaccgcccgagaattttttgggctaacaaaaccggcttaagcctgttatgtaatcaaaccgaaatacggaaccgagaatctgatgagtgactataaatcaaccctgaatttgccggaaacagggttcccgatgcgtggcgatctcgccaagcgcgaaccgggaatgctggcgcgttggactgatgatgatctgtacggcatcattcgtgcagctaaaaaaggcaaaaaaaccttcattctgcatgatggccctccttatgcgaatggcagcattcatattggtcactcggttaacaagattctgaaagacattatcattaagtccaaagggctttctggatatgactcgccgtatgtgcctggctgggactgtcatggtctgccaatcgaactgaaagtagagcaagaatacggtaagccgggggagaaattcaccgccgctgagttccgcgccaagtgccgcgaatacgctgcgacccaggttgacggtcagcgcaaagactttatccgtctgggcgtgctgggcgactggtcgcacccgtacctgaccatggacttcaaaactgaagccaacatcatccgcgcgctgggcaaaatcatcggcaacggtcacctgcacaaaggcgcgaagccggtgcactggtgcgttgactgccgttctgcattggcagaagcggaagttgagtattacgacaaaacttctccgtccatcgacgtcgctttccaggcggtcgatcaggatgcgcttaaaacgaaatttggcgtaagcaatgttaacggcccaatttcgctggttatctggaccaccacgccgtggacgctgcctgctaaccgcgcaatctccattgcacctgattttgattatgcgctggtgcaaatcgacggtcaggccgtgatcctcgcgaaagatctggttgaaagcgtaatgcagcgtatcggcgttagcgattacaccattcttggcacggtgaaaggtgccgagctggaactgttgcgctttacccatccgtttatggacttcgatgttccggcaattctcggcgaccacgttacgctggatgccggtaccggtgccgttcataccgcgccaggccacggtccggacgactatgtgatcggtcaaaaatatggtctggaaaccgctaacccggttggcccggacggaacttatctgccgggtacttacccgactctggatggcgttaacgtcttcaaagcgaacgatattgtcattgcgttgttgcaggaaaaaggcgcactgttgcacgttgagaaaatgcaacacagctatccgtgctgctggcgtcataaaacgccgatcatcttccgcgcgacgccgcagtggttcgtcagcatggatcagaaaggtctgcgtgcgcagtcactgaaagagatcaaaggcgtgcagtggatccctgactggggccaggcgcgtatcgagtcgatggttgctaaccgtcctgactggtgtatctctcgtcagcgtacctggggcgtaccgatgtcactgttcgtgcataaagacacggaagagctgcatccgcgtaccctcgaactgatggaagaagtggctaaacgcgtggaagttgacggcatccaggcgtggtgggatctcgatgcgaaagagatcctcggcgatgaagctgatcagtacgtgaaagtgccggatacgctggatgtatggtttgactccggatctacccactcttccgttgttgacgtgcgtccggaatttgccggtcacgcagcggacatgtatctggaaggttctgaccaacaccgtggctggttcatgtcttccctgatgatctctaccgcgatgaagggcaaagcgccatatcgtcaggtactgacccacggctttaccgtggatggtcagggccgcaagatgtctaaatccatcggcaacaccgtttcgccgcaggatgtgatgaacaaactgggcgcggatattctgcgtctgtgggtggcatcaactgactacaccggtgaaatggccgtttctgacgagatcctgaaacgtgctgccgacagctatcgtcgtatccgtaacaccgcgcgcttcctgctggcaaacctgaacggttttgatccggcaaaagatatggtgaaaccggaagagatggtggtactggatcgctgggccgtaggttgtgcgaaagcggcacaggaagacatcctcaaggcgtacgaagcatacgatttccacgaagtggtacagcgtctgatgcgcttctgctccgttgagatgggttccttctacctcgacatcatcaaagaccgtcagtataccgccaaagcggacagcgtggcgcgtcgtagctgccagactgcgctgtatcacatcgcagaagcgctggttcgctggatggcaccaatcctctccttcaccgctgatgaagtgtggggttacctgccgggcgaacgtgaaaaatacgtcttcaccggcgagtggtacgaaggcctgtttggtctggcagacagtgaagcaatgaacgatgcgttctgggacgagctgttgaaagtgcgtggcgaagtgaacaaagtcattgagcaagcgcgtgccgataagaaagtgggcggctcgctggaagcggcagtaaccttgtatgcagaaccggaactggcggcgaaactgaccgcgctgggcgatgaattacgatttgtcctgttgacctccggcgctaccgttgcagactataacgacgcacctgctgatgcccagcagagcgaagtcctcaaagggctgaaagtcgcgttgagtaaagccgaaggtgagaagtgcccacgctgctggcactacacccaggatgtcggcaaggtggcggaacacgcagaaatctgcggccgctgtgtcagcaacgtcgccggtgacggtgaaaaacgtaagtttgcctgatgagtcaatcgatctgttcaacagggctacgctggctgtggctggtggtagtcgtgctgattatcgatctgggcagcaaatacctgatcctccagaactttgctctgggggatacggtcccgctgttcccgtcgcttaatctgcattatgcgcgtaactatggcgcagcgtttagtttccttgccgatagcggcggctggcagcgttggttctttgccggtattgcgattggtattagcgtgatcctggcagtgatgatgtatcgctcgaaggccacgcagaagctaaacaatatcgcttacgcgctgattattggcggcgcactgggcaacctgttcgaccgcctgtggcacggcttcgttgtcgatatgatcgacttctatgtcggcgactggcacttcgccaccttcaaccttgccgatactgccatttgtgtcggtgcggcactgattgtgctggaaggttttttaccttctaaagcgaaaaaacaataataaaccctgccggatacgatgctgacgcatcttatccggcctacagattgctgcgaaatcgtaggtcgcatccggcaaaaatcctcaaaatataagagcaaacctgcatgtctgaatctgtacagagcaatagcgccgtcctggtgcacttcacgctaaaactcgacgatggcaccaccgctgagtctacccgcaacaatggtaaaccggcgctgttccgcctgggtgatgcttctctttctgaagggctggagcaacacctgctggggctgaaagtgggcgataaaaccaccttctcgctggagccagatgcggcgtttggcgtgccgtcaccggacctgattcagtacttctcccgccgtgaatttatggatgcaggcgagccagaaattggcgcaatcatgctttttaccgcaatggatggcagtgagatgcctggcgtgatccgcgaaattaacggcgactccattaccgttgatttcaaccatccgctggccgggcagaccgttcattttgatattgaagtgctggaaatcgatccggcactggaggcgtaacatgcagatcctgttggccaacccgcgtggtttttgtgccggggtagaccgcgctatcagcattgttgaaaacgcgctggccatttacggcgcaccgatatatgtccgtcacgaagtggtgcataaccgctacgtggtcgatagcctgcgcgagcgtggggctatctttattgagcagattagcgaagtaccggacggcgcgatcctgattttctccgcacacggtgtttctcaggcagtacgtaacgaagcgaaaagccgcgatttgacggtgtttgatgccacctgtccgctggtgaccaaagtgcatatggaagtcgcccgcgccagccgtcgtggtgaagaatctattctcatcggtcacgccgggcacccggaagtggaagggacgatgggccagtacagcaacccggaagggggaatgtatctggtcgaatcgccagacgatgtgtggaaactgacggtcaaaaacgaagagaagctctcctttatgacccaaaccacgctgtcggtggatgacacgtctgatgtgatcgacgcgctgcgtaaacgcttcccgaaaattgtcggtccgcgcaaagatgacatctgctacgccacgactaaccgtcaggaagcggtacgcgccctggcagagcaggcggaagtagtactggtggttggttcgaaaaactcttccaactccaaccgtctggcggaactggcccagcgtatgggcaaacgcgcgtttttgattgacgatgcgacagatatccaggaagagtgggtgaaagaggcgaaatgcgtcggcgtgactgctggcgcatcagctccggatattctggtacagaacgtagtcgcacgtttacagcagcttggcggtggcgaagccattccgctggaaggtcgtgaagaaaacattgttttcgaagtgccgaaagagctgcgtgtcgatattcgtgaagtcgattaagtcattagcagcctaagttatgcgaaaatgccggtcttgttaccggcattttttatggagaaaacatgcgtttacctatcttcctcgatacagaccccggcattgacgatgccgttgccattgccgccgcgatttttgcccccgaactcgatctgcaactgatgaccactgtcgcgggtaatgtttcggtagagaaaaccacccgcaacgccctgcaactgctgcatttctggaatgtggatattccgcttgcccagggcgctgccgtaccactggttcgtgcgccgcgcgatgcggcatctgtacacggtgaatcgggaatggctggctatgactttgttgaacacaaccgtcagccactgggtataccggcgtttctggcaattcgtgatgccctgatgcgtgcgccagagcccgttaccctggtggccatcggcccgttaaccaatattgcgctgttactttcacaatgcccggaatgtaagccgtatattcgccgtctggtgatcatgggcggttctgctggtcgcggcaactgcacaccaaacgccgagtttaatatcgctgccgatccagaagcggcagcctgtgtcttccgtagcggcatcgaaatcgtcatgtgcggtctggatgtcaccaatcaggcaatattaacccctgactatctcgctactttgccggaattgaatcgcaccggaaaaatgctacacgccctgtttagccactaccgtagcggcagtatgcaaagtggactacgtatgcacgatctttgcgctatcgcctggctggtgcgcccggaattgttcactctcaaaccgtgttttgtcgcggtagaaactcagggtgaatttacctcaggcacgacggttgttgatatcgacggttgcctgggcaaaccagccaatgtacaggtggcgctggatctggatgtgaaaggcttccagcaatgggtggctgaggtgctggccctggcgctctaataataaaacaaggaagtgttctatgacgtatggagaagcgtatctggaagggtggaaaaacatctttaattatgaaggtgtttccaatcgcttcgagttctggtcgtttatgattggtagtggcgttatctgtctgcttccgcttttatgttggtggttagcggtaacaattaacaatgactatggtgttttcattttttttgcgctgcccgcgtcatttattttaacgttgatttttgccataccggcgatagcgttagccgtcagaaggatgcacgatatcggatattcagggtggtgggttaccattgtcgtgttgatccctgttacgggcgtaattctgcttatactgtgctgcctgccgtcaaagtcacaagaccaggcataatgacagagggtatgacgcatcactttctgcgtcatgcctttcactgatatccctccctgtttatcattaatttctaattatcagcgtttttggctggcggcgtagcgatgcgctggttactctgaaaacggtctatgcaaattaacaaaagagaatagctatgcatgatgcaaacatccgcgttgccatcgcgggagccgggggccgtatgggccgccagttgattcaggcggcgctggcattagaaggcgtgcagctgggcgcggcgctggagcgcgaaggatcttctttactgggcagcgatgcgggcgaactggccggagccgggaaaacaggcgttactgtgcaaagtagtcttgatgcgataaaagatgattttgatgtgtttatcgattttacccgtccggaaggtacgctgaaccatctcgctttttgtcgccagcatggcaaagggatggtgatcggcactacggggtttgacgaagccggtaaacaggcgattcgtgacgccgccgccgatattgcgattgtctttgccgccaattttagcgttggcgttaacgtcatgcttaaactgctggagaaagcagccaaagtgatgggggactacaccgatatcgaaattattgaagcacatcatagacataaagttgatgcgccgtcaggcaccgcactggcaatgggagaggcgatcgcccacgctcttgataaagatctgaaagattgcgcggtctacagtcgtgaaggccataccggtgaacgtgtgcctggcaccattggttttgccaccgtgcgtgcaggtgacatcgttggcgaacataccgcgatgtttgccgatattggcgagcgtctggagatcacccataaggcatccagccgcatgacatttgctaacggtgcggtaagatcggctttgtggttgagtggtaaggaaagtggtctttttgatatgcgagatgtgcttgatctcaataatctgtaaccacaagatatttatggtgatgcaaaaacaacacatttaattcgttgaatataaagggctttaatttttggcccttttgtttttagtgttatgcttttaaatctaatgcaaatgctgaaaattacatgttttgtattctgtttttgttgttttaatgtaaattttgaccatttggtccacttttttctgctcattttgatttcatgcaatcttcttgctgcgcaagcgttttccagaacatgttatatgatctttttgtcgcttaatgcctgtaaaacatgcatgagctacaaaataatataaaaaatcccgccattaagttgacttttagctcccatatctccagaatgccgccgtttgccagaaattcgtcggtaagcagatttgcattgatttacgtcatcattgtgaattaatatgcaaataaagtgagtgaatattctctggagggtgttttgattaagtcagcgctattggttctggaagacggaacccagtttcacggtcgggccataggggcaacaggttcggcggttggggaagtcgttttcaatacttcaatgaccggttatcaagaaatcctcactgatccttcctattctcgtcaaatcgttactcttacttatccccatattggcaatgtcggcactaatgacgccgatgaagaatcttctcaggttcatgcccaaggtctggtgattcgcgacctgccgctgattgccagcaacttccgtaataccgaagacctctcttcttacctgaagcgccataacatcgtggcgattgccgatatcgatacccgtaagctgacgcgtttactgcgtgagaaaggtgctcagaatggctgcattattgcgggtgacaacccggatgcggcgctggcgttagaaaaagcccgcgcgttcccaggtctgaacggcatggatctggcaaaagaagtaaccaccgcagaaccctatagctggacacaagggagctggacgctgaccggcggcctgccagaagcgaaaaaagaagacgagctgccgtaccacgtcgtggcctacgatttcggtgccaagcgcaacatcctgcgtatgctggtggatagaggctgtcgcctgaccatcgttccggcgcaaacttctgcggaagatgtgctgaaaatgaatccggacggcatcttcctctccaacggtcctggcgacccggccccgtgcgattacgccattaccgctatccagaaattcctcgaaactgatattccggtattcggcatctgcctcggtcatcagctgctggcgctggcgagcggtgcgaagactgtcaaaatgaaatttggtcaccacggcggcaaccatccggttaaagatgttgagaaaaatgtggtgatgatcaccgcccagaaccacggttttgcggtggatgaagcaacattacctgcaaacctgcgtgtcacacataaatccctgttcgacggtacgttacagggcattcatcgtaccgataaaccggcgttcagcttccagggacacccggaagccagccctggtccacacgacgccgcgccgttgtttgaccactttatcgcgttaattgagcagtaccgtaaaaccgctaagtaatcaggagtaaaagagccatgccaaaacgtacagatataaaaagtatcctgattctgggtgcgggcccgattgttatcggtcaggcgtgtgagtttgactactctggcgcgcaagcgtgtaaagccctgcgtgaagagggttaccgcgtcattctggtgaactccaacccggcgaccatcatgaccgacccggaaatggctgatgccacctacatcgagccgattcactgggaagtggtacgcaagattattgaaaaagagcgtccggacgcggtgctgccaaccatgggggggcagacggcgctgaactgtgcgctggagcttgagcgtcagggcgtgctggaagagttcggcgtcaccatgattggtgccactgccgatgcgattgataaagccgaagaccgccgccgtttcgacgtagcgatgaagaaaatcggtctggaaactgcgcgttccggtatcgctcattcaatggaagaagcgctggcggttgccgctgaagttggcttcccgtgcattattcgcccatcctttaccatgggcggtagcggtggcggtatcgcttataaccgtgaagaatttgaagaaatttgcgcccgcggtctggatctttctccgactaaagagctgctgattgatgagtcgctgatcggctggaaagagtacgagatggaagtggtgcgtgataaaaacgacaactgcatcatcgtctgctctatcgaaaactttgatgcgatgggcatccacaccggtgactccatcactgtcgcgccagcccaaacgctgaccgacaaagaatatcaaatcatgcgtaacgcctcgatggcggtactgcgtgaaatcggcgttgaaaccggtggttccaacgtccagtttgcggtgaacccgaaaaacggtcgcctgattgttatcgaaatgaacccacgcgtgtctcgctcctctgcgctggcgtcgaaagccactggtttcccgattgccaaagtggcggcgaaactggcggtgggttacaccctcgacgagctgatgaacgacatcaccggtgggcgtactccggcctccttcgagccgtccatcgactatgtggttactaaaattcctcgcttcaacttcgagaaattcgccggtgctaacgaccgtctgaccactcagatgaaatcggtgggcgaagtgatggcgattggtcgcacgcagcaggaatccctacaaaaagcgctgcgcggcctggaagtgggcgcaactggcttcgatccgaaagtgagtctcgacgacccggaagcgctgactaaaatccgccgcgaactgaaagatgctggcgcagagcgtatctggtatatcgctgatgccttccgcgcgggcctgtctgtagacggtgtatttaatttgaccaacattgaccgctggttcctggtacagattgaagagctggtgcgtctggaagagaaagtcgcagaagtgggcatcactggcctgcacgctgaattcctgcgccagttgaaacgcaaaggctttgccgatgcgcgtctggctaaactggcgggcgtgcgcgaagcggaaatccgcaagttgcgcgaccagtatgatctgcacccggtttacaagcgcgtggatacttgtgcggcagagttcgccaccgacaccgcttacatgtactccacttatgaagaagagtgcgaagcgaatccgtccaccgatcgtgaaaaaatcatggtgctcggcggcggcccgaaccgtatcggtcagggtatcgaattcgactactgctgtgtacacgcctcgctggcgctgcgcgaagatggttatgaaaccattatggttaactgtaacccggaaaccgtctccaccgactacgacacctccgaccgcctctacttcgagccggtaactctggaagacgtgctggaaattgtgcgtattgagaagccgaaaggcgttatcgtccagtacggcggtcagaccccgctgaaactggcgcgcgcgctggaagctgctggcgtaccggttatcggtaccagcccggatgccatcgaccgtgcggaagaccgtgaacgcttccagcatgcggttgagcgtctgaaactgaaacaaccggcgaacgccaccgttaccaccatcgaaatggcggttgagaaagcgaaagagattggctacccgctggtggtgcgtccgtcttacgttctcggcggtcgggcgatggaaatcgtctatgacgaagctgacctgcgtcgctacttccagacagcggtcagcgtatctaacgatgcgccagtgttgctggaccacttccttgatgacgcagtagaagttgacgtggatgccatctgcgatggcgaaatggtgctgattggcggcatcatggagcatattgagcaggcgggcgtgcactccggtgactccgcatgttcgctgccagcctacaccttaagtcaggaaattcaggatgtgatgcgccagcaggtgcagaaactggccttcgaactgcaggtgcgcggcctgatgaacgtgcagtttgcggtgaaaaacaacgaagtctacctgattgaagttaacccgcgtgcggcgcgtaccgttccgttcgtctccaaagccaccggcgtaccgctggcaaaagtggcggcgcgtgtgatggctggcaaatcgctggctgagcagggcgtaaccaacgaagttatcccgccgtactactcggtgaaagaagtggtgctgccgttcaataaattcccgggcgttgacccgctgttagggccagaaatgcgctctaccggggaagtaatgggcgtgggccgcaccttcgctgaagcttttgccaaagcgcagctgggcagcaactccaccatgaagaaacacggtcgtgcgctgctttccgtgcgcgaaggcgataaagaacgcgtggtggacctggcggcaaaactgctgaaacagggcttcgagctggatgcgactcacggcacggcgattgtgctgggcgaagcgggtatcaatccgcgtctggtgaacaaggtgcatgaaggccgtccgcacattcaggaccgtattaagaatggcgaatatacctacatcatcaacaccacctcaggtcgtcgtgcgattgaagactcccgcgtgatccgtcgcagtgcgctgcaatataaagtgcattacgacaccaccctgaacggcggctttgccaccgcgatggcgctgaatgccgatgcgaccgaaaaagtaatttcggtgcaggaaatgcacgcgcagatcaaataatagcgtgtcatggcggatatttttcatccgctaatttgatcgaataactaatacggttctctgatgaggaccgttttttttgcccattaagtaaatcttttggggaatcgatatttttgatgacataagcaggatttagctcacacttatcgacggtgaagttgcatactatcgatatatccacaattttaatatggccttgtttaattgctgcaaaacgagtcatagccagtcttttaatttgtgaaactggagttcgtatgtgtgaaggatgtgttgaaaaaccactctatttgttaatcgccgaatggatgatggctgaaaaccggtgggtgatagcaagagagatctctattcatttcgatattgaacacagcaaggcggttaataccctgacttatattctgtcggaagtcacagaaataagctgcgaagttaagatgattcctaataagctggaagggcggggatgccagtgccagcgactggtaaaagtggttgatatcgatgagcaaatttacgcgcgcctgcgcaataacagtcgggaaaaattagtcggagtaagaaagacgccacgtattcctgccgttccgctcacggaacttaaccgcgagcagaagtggcagatgatgttgtcaaagagtatgcgtcgttaatgtcatttcgttgataccgtgcgacctggtcgccggatgcaatgctggcgcatcttatctggcctacggttgctttccagccaggtcggataaggcgtttacgccgcatccggaaagatcaccgtttcggcatcacatccgtcgtcccctgcaaacgggggcgattttcctccatttgcctcagtggctgcgtttcatgtaacgatgcatgacagcgcccgacaagatcctgatactctttggtattcaaccgtttccagtgtaactcgtcgtcactcacactgcgtacagcgcgggctggcgtacccatcaacaactggcgtttctcgccgcgaaagcccgctttgacaaagctcatagcggcaacaatgctctcttcgccaatgaccgcgccatccataatcacgctgttcataccgaccagtgcatcgcgaccaatcacacaaccatgcaggatcgctccgtgcccgatatgaccgttttccccaacgatggtgtcagtgtcgcagtagccatgcataatgcagccatcctgaatattggctcccgcttgcacgatcaaccgcccgtagtcaccacgcagtgaggcgagtgggccgatgtagacaccggctcccacaatcacatcgccaatcaagactgcgctgggatggacaaacgccgtcgggtgaacaaccggaattaacccctcaaaggcgtaatagctcacggttgttaacgtcctttccacactggatcgcgcttctcggcaaacgccagcggcccttcaatggcatcctccgaatgcagaaccgatggatagtgtttcaacacgccgctgcgaatatagcgatacgcttcttctaccggcatttcactggtggtgcggtagatctctttcagcgccgcaatcgccagcggagcgctgttaaccagctgctgcgccagttcgcgggcgttatccatcagttccgcctggctaaccacgcggttgactaccccccaacgcagcgcctcttctgcgcccattcgtctgccggtcatcaccatttcattgacgatggcaggcggcaggatcttcggcagacgcagcacgccgccgctgtcagggacgatgcccagtttcgcttccggcagggcgaagctggcgttatcggcacaaacaataaaatctgccgccagcgccagttcaaagccgccgccaaaggcatagccgttcacagcggcgataaccggtttgtcgagattgaaaatttcggttaatcccgcaaaacctcccgggccaaagtcagcatccggtgcttcgccttctgctgccgcttttaaatcccagcccgcggaaaagaatttctctccggcaccggtaataatggcgacacgtaattgcggatcgtcacggaaatttagaaatacttcgcccatttcaaagctggtttttgcatcaatagcattcgcttttggacgatcaagggtaatttccagaattgatccattgcgggttagatgtaatgattcactcattccttttctccatttttgctttttcagggacgacatccctgcaaaaaatgcatattgttttagagcgtgattattagctggcagggtagttccctgccgtttcatttatttcagattctttctaattattttccccgagcaattacgtggcagatcttttctgatctccagataagagggcactttaaatttcgccatattctgttcacagaagcagaagaattcctcttcgctcaatgtttcaccttcattcagcaccacaaatgctttgatggcttcatcgcgaatcgaatctttaatacccacaaccacgatatcctgaattttgggatgggtggcgatgatattttcgagctccacgcaggagacattctcgccaccgcgtttgatcatattgcagcggcgatcgacgaaataaaaaaagccctcttcgtcgcggtatccggtatcgccggtatgtagccagccatcggcttccagcactttcgcagtggctttcgggttgagaaaatattctttgaagatggttttccctggtacgcctttaatacagatttcaccgatttcacctgccgggagcgggcgattgtgatcgtcgcagatctccgcttcgtagcaaaaccccgcccgaccaatcgacggccagcgtcgtttatcgccagggcgatcgccgataatgccaacaatggtttccgtcatcccataagacgtcagcaagcgaacgccgaagcgttcacaaaacgcgtctttttcctgctccgacaagttgagataaaacatcacttcccgcaggcggtgttgctgatcgttcgctgaaggcggctgcaccatcaacgtacggatcatcatcggaatacattcggtaatggtggcgcggtacttctgcacctgtccccagaaggcacgggcgctgtatttctcgaccagcacaaaggtggccccggcagaaaacgccgccatcgccgcagtacactggcaatcgatatgaaacgcaggcattaccgtcaggtagacgtcatcgtcacgcagtgcacactgccaggcggagtaatatccagcgaagcgcaggttgtaatgagttatcaccacccctttcggtcgggaggtggtgccggaggtgaagagaatttccgccgtatcgtcagtcgatagcggcggtgcatagcacaaggtggcaggttgttgatttttcaattgagtaaacgaactcacgccatcatcagcgggaagtgccatatctgtcaggcaaatgtgccgcaactcagaggcatcttcctgctgaatctgttgatacataggataaaattgcgcactggtcaccagcaggcacgcctggctattttgcaggatccacgtgctttcttcgcgcaacaggcgggcgttaatcggcaccataatcgcgccaatttttgccaacccgaaccagcaaaagataaattccgggcagttgtcgagatgtagagcaaccttgtcgcctttgcgaatccccagcacataaaacaggtttgccgtgcggttaatctcctgatttaactcaagataactataccggttaacgactccgctgctggattcacaaatcagcgccgttttatgaccgtaaacgtccgccagatcgtcccacatttgacgtagatgttgtccgccaatgatatccattgcacctctatccattttgttcgtttgttattgagcgggcgctagtcaggcaagctgactgacgccacgcgtttagtcctcaactttggccagacctttgctgaccaactcctgaatgtcgttttcgctgtagccgatatttttcaaaatggcagccgtgtccatgccatgtgagggcattccgcgccagatttgtccggggttatttttgaatttcggcatgatattcggccctttgcaggtgcgaccatccatcgtttgccactgagtgattgattcgcgagccacatactgtggattgctttccagttccggcacggtcagtactttggcacaggcgatattcagttcggcaaagcgttctttaacttctgcgatggtatgtgccgccagccaggcatcgagtttctcttctaccagtgggccgtaagggcattcgatacggtggataagctgagtgccttccgggatttccggcgtaccgagcaggtgtgcgaggccaatatctttaaagcactctgcaatttgagtaatgcccaccagttccatcacgatgtagccgtcggcgcatttatacagaccgcaaccggcgtagtagggatctttacctttggtcatgcgcgggcacatttcgccgccgttgaagtaatccatcatgaagtactggcccatacgcagcatcacttcatacatggcgatgtcgatactttcgcctttgccggtttcacgcactttatgcagtgctgccagcgccgccgtggtggcagtcaggccagaaaagtaatcggcggtatacgggaaggcaggcattggctggtcaacatcaccgttctgaatcaggtaaccactgaaggcctgggcgatagtgttataggccggaagattggtgtactcctcggtgccgtactgaccaaaaccggacagatgagcgataaccagttttgggttgtgctgccacaggacttcatcggtaatgccacgacgggcaaaggccggacctttactggcttcgatgaagatatcggtggtttccattaatttcagaaacgcttcgcgcccttcatctttgaaaatatttaacgacagcgcatgcaaattgcggcgggagagctgcgggtagttcggttgaacgcgaatggtgtcggcccaggcgacgttctcgatccagataacttccgccccccattctgcgaacatttgcccggcaaacggtccggcgatttcgataccggagaagacaacgcgcaatccggccagcggcccgaatttcggcatgggtagatgatccattattagctcctgaaaaatttatgtagcgcatgactgccggatgcggcgtaaacgccttatccggccatcttcgtgctcccgtaggcctgataagacgcgtcagcgtcgcatcaggcagcgcacggacttaacggtattgcttcagcaccgcgcgacccagcgtcaggatctgcatttcgtcagatcctccggaaacgcggtctacacgcaggtcacgccagaagcggctgatgcggtggttgcccgcaatcccgacaccgcccagcacctgcattgcgctatccaccacttcaaatgccgcattggcgcagaagtatttgcacatcgctgcatcgccagaggtgatggtgccgttgtctgctttccacgctgcttcatacagcatgtttttcatggagtttaatttgatcgccatgtgggcgaatttttcctgaatcaactggaaacgaccaatagcctcgccaaactgcacgcgctggttggcgtagcgcgccgcatcttcaaaggcgcacatcgccgtaccgtagttggtcagggctaccaggaaacgttcatggtcgaactcttctttgacgcggttaaagccgttaccttcccgaccgaacatgtctttctcgtccagttccacgtcgtcaaaagtgatttcacagcagctatccatacgcagaccgagcttttcaagtttggtcactttgatgcccggtttgctcatatcaacaaaccattcggtgtagacaggtttgtccggagaagccccgtcgcgcgccatcaccacgatgtacggggtgtaggcgctactggtaataaaacacttactaccattaagataaatcttaccatttctacgggtataagtcgttttcaggctacccacgtcggagcctgcgcccggttcggtaatcgctgagttccacatctgcttaccggtgccgcggaaagccatgatcttgtcgatctgctcttgcgtaccttcacgcaggaaggtgttaaacccgcccggtaactgatacagcacgtaagttggcgctcccagacgacccagttccatccacacggcggcgagagtaacaaaccccgcgtccagaccaccgtgctcttcagggatcagcagactgtcgatacccatatccgccagggctttgacaaaacgttccgggtagacgctgtcacggtcgcactcggcaaaataggcttcccagttttcgctggccatcagttcgcggataccggcgacaaacagttcctgctcatcatttaaattaaaatccatctttcaacctcttgatattttgggggttaattaatctttccagttctgtttcgcgtctttaataaaggagagcgtcaccatgatgttgacgaagaacagcgggcatcctccggcgataatggcggtttgaatcggtttcaggccgccgagcgccagcagaacaataccgataatgccaaccagaactgaccaaccaatgcgcaccagcagcgggggttcttcgccgtcacgcacttcgcggcaagtggacatcgccagggtataagagcaggcgttaaccagcgtaacggtggcaataaagcagaggatgaagaagccccacatggtggcggtgctgagtggcagagcggcccaggtttcgatgatggcgcgcgccacaccgtactgttcgatcagatttggaatgttgatgatgtttttatctatcaacagcagagtgttactaccgagtacagtccacaggatccatgttgacgctgtcagccccagcaccatgccgaagcacagttcacgcacggtacgaccacgggagatgcgggcgaggaagatactcatctggatagcgtaaatcacccaccatgcccagtagaacacggtccagccctgcgggaagccgcctttagcgatgggatcggtatagaacaacatgcgcggcagatacatcagcaacatccccaccgaatcggtgaagtagttcatgatgaagctggcaccgctgacgatgaacacccaacccagcatcaggaagctcaggtaactacgcacgtcactggcgatacgtacccctttttgcagaccgcaagcgacgcaaatggtgttgaggataatccagcaggtaatgatgatagcgtccagttgcagggtatgcggaatgccaaacaaccattgcatacactcggtcaccagcggcgtggcaaggcccagactggtacccatcgcgaagatcaaggcgacgaggtagaagttgtcgacgatagtgccgaacaaccctttggcgtgtttttcacctaccagcggcaccagggtcgagctggggcgaatcacttccattttgcggacaaagaagaagtaagcgaaggcgactgaaaggaagctgtaagtggcccacggcagaggtccccagtggaacaagctgtaagccagccccaactctttcgcgccagttgagttcggttctaagccaaacggcggggtggagatgtagtagtagatctcaatcgatccccagaacagtacggcagcagacgtacaggaggcgaacatcataaagatccaactggcggtactaaattctggtggttcgttacctaaacgctttttggcatacgggccaaacaccagccagaaccagccgaaaagcatcaccaccatataccattcaaatgcccatccccatacattggtgacgtaactgaatacagcattaataacgacattcgccgcatccagatctctgactgtaagccaacaaagtatgccgacgattattaacggcggaaagaaaaccttcggttctattcccgtttttctcttttcattcttcatgagttaattccactgtgaaaacgaatatttattttgcgttcccgtttgttttattttttgttaacatttaatataattattattaacctcgtggacgcgttaatggctaactcataatgggtattcaataagctgcattctgtgattgttatcacatttttgtttcgggtgaatagagggcattttttcgttaattttgattattaatcagtttgttatattatgttgtgagtaaaaaaatagcatctgactttcaatattggcgatccataaaacaatattgaaaatttcttttttctacgccatgttttcaatattggtgaggagcttaataatattgcaagttggatttatctgcgtgtgacattttcaatattggtgattaaagttttatttccaaattaaagggcgtgatatctgtaattaacaccaccgatatgaacgacgtttccttcatgatttctggagatgcaatgaagattattacttgctataagtgcgtgcctgatgaacaggatattgcggtcaataatgctgatggttcgttagacttcagcaaagccgatgccaaaataagccaatacgatctcaacgctattgaagcggcttgccagctaaagcaacaggcagtagaggcgcaggtgacggccttaagtgtgggcggtaaagccctgaccaacgccaaagggcgtaaagatgtgctatcgcgcggtccggatgaactgattgtggtgattgatgaccagttcgagcaggcactgccgcaacaaacggcgagcgtactggctgcagccgctcagaaagcaggctttgatttgatcctctgtggcgatggttcttccgacctttatgcccagcaggttggtttgctggtaggcgaaatccttaatattccggcagttaacggcgtcagcaaaattatctccctgactgcagataccctcaccgttgagcgcgaactggaagatgaaacagaaaccttaagcattccgctgcctgcggttgttgctgtttccactgatatcaactccccacaaattccttcgatgaaagccattctcggcgcggcgaaaaagccagtccaggtatggtcggcggcggatatcggttttaatgcagaggcagcctggtcagaacaacaggttgccgcgccgaaacagcgcgagcgtcagcgcatcgtgattgaaggcgacggcgaagaacagatcgccgcatttgctgaaaatcttcgcaaagtcatttaattacaggggatgctatgaacacgttttctcaagtctgggtattcagcgataccccttctcgtctgccggaactgatgaacggtgcgcaggctttagctaatcaaatcaacacgttcgtcctcaatgatgccgacggcgcacaggcaatccagctcggcgctaatcatgtctggaaattaagcggcaaaccggacgagcggatgatcgaagattacgccggtgtcatggctgacactattcgccagcacggcgcagacggtctggtgctgttgccaaacacccgtcgcggcaaattactggcggcgaaactgggttaccgccttaacgcggcggtgtctaacgatgccagcgctgttagcgtgcaggacggtaaagcgacagtgaaacacatggtttacggcggtctggcgattggcgaagaacgcattgccacgccgtatgcggtactgaccatcagcagcggcacgttcgatgtggctcagccagacgcgtcacgcactggcgaaacgcacaccgtggagtggcaggctccggctgtggcgattacccgcacggcaacccaggcgcgtcagagcaacagcgtcgatctcgacaaagcccgcctggtggtcagcgttggtcgcggtattggcagcaaagagaacattgcgctggcagaacagctttgcaaggcgataggtgcggagttggcctgttctcgtccggtggcggaaaacgaaaaatggatggagcacgaacgctatgtcggtatctccaacctgatgctgaaacctgaactgtacctggcggtggggatctccgggcagatccagcacatggttggcgctaatgcgtcgcaaaccattttcgccatcaacaaagataaaaatgcgccgatcttccagtacgcggattacggcattgttggcgacgccgtgaagatccttccggcactgaccgcagctttagcgcgttgatccactctggcagggctgcattttggccctgccgctgacagggagctcttatgtccgaagatatctttgacgccatcatcgtcggtgcagggcttgccggttcggttgccgcactggtgctcgcccgcgaaggtgcgcaagtgttagttatcgagcgaggcaattccgctggtgccaagaacgtcaccggcgggcgtctctatgcccacagtctggaacacattattcctggtttcgctgactccgcccccgtagaacgcctgatcacccatgaaaaacttgcgtttatgacggagaagtcagcgatgactatggactactgcaatggcgacgaaacctcgccatcccagcgttcttactccgttttgcgcagtaaatttgatgcctggctgatggagcaggccgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggggtgaattccatccttgccgaaaagctggggatggcaaaacgcgttaaaccgacggatgtggcggttggcgtaaaggaactgatcgagttaccgaagtcggttatcgaagaccgttttcagttgcagggtaatcagggcgcggcttgcctgtttgcgggatcacccaccgatggcctgatgggcggtggcttcctttataccaatgaaaataccctgtcgctggggctggtttgtggtttgcatcatctgcatgacgcaaaaaaatcggtgccgcaaatgctggaagatttcaaacaacatccggccgttgcaccgctgatcgcgggcggcaagctggtggaatattccgctcatgtagtgccggaagcaggtatcaacatgctgccggagctggttggtgacggcgtattgattgccggtgatgctgccggaatgtgtatgaacctcggttttaccattcgcggtatggatctggcgattgccgccggggaagcagcagcaaaaactgtgctttcagcgatgaaaagcgacgatttcagtaagcaaaaactcgcggaatatcgtcaacatcttgagagtggcccgctgcgcgatatgcgcatgtaccagaaactaccggcgttccttgataacccacgcatgtttagcggctacccggaactggcggtgggcgtggcgcgtgacctgttcaccattgacggcagtgcgccggaactgatgcgcaagaaaatcctccgccacggcaagaaagtgggcttcatcaatctgatcaaggatggcatgaaaggagtgaccgttttatgacttctcccgtcaatgtggacgtcaaactgggcgtcaataaattcaatgtcgatgaagagcatccgcacattgttgtgaaggccgatgcagataaacaggccctggagctgctggtgaaagcgtgccccgcaggtctgtacaagaagcaggatgacggcagtgtgcgcttcgattacgccggatgtctggagtgcggcacctgtcgcattctggggctggggtcggcgctggaacagtgggaatacccgcgcggcacctttggtgtggagttccgttacggctgatgttggtttgatacgtaatgccgtactgactctcattgcaaaaaaacaggaataacccatgcaaccgtccagaaactttgatgatcttaaattctcctctattcaccgccgcattttgctgtggggaagcggtggtccgtttctggatggttatgtactggtaatgattggcgtggcgctggagcaactgactccggcgctgaaactggacgctgactggattggcttgctgggcgcgggaacgctcgccgggctgttcgttggcacatcgctgtttggctatatctccgataaagtcggacggcgcaaaatgttcctcattgatatcatcgccatcggcgtgatatcggtggcgacgatgtttgtctcatcccccgtcgaactgttggtgatgcgggtacttatcggcattgttatcggtgcggattatcctatcgccacctcaatgatcaccgagttctccagtacccgtcagcgggcgttttccatcagctttatcgccgcgatgtggtatgtcggcgcgacctgcgccgatttggtcggctattggctttatgatgtggaaggcggctggcgctggatgctgggtagcgcagcgattccctgtttgttgattttgattggtcgattcgaactgcctgaatctccccgctggttgttacgcaaagggcgagtaaaagagtgcgaagagatgatgataaaactgtttggcgaaccggtggctttcgaggaagagcagccgcagcaaacccgttttcgcgatctgtttaatcgccgccattttccttttgttctgtttgttgccgccatctggacctgccaggtgatccccatgtttgccatttacacctttggcccgcaaatcgttggtttgttgggattgggggttggcaaaaacgcggcactggggaacgtggtgattagcctgttctttatgctcggctgtattccgccgatgctgtggctaaacactgccggacggcgtccattgttgattggcagctttgccatgatgacgctggcgctggcggttttggggctgatcccggatatggggatctggctggtagtgatggcctttgcggtgtatgcctttttctctggcgggccgggtaatttgcagtggctctatcctaatgaactcttcccgacggatatccgcgcctctgccgtgggcgtgattatgtccttaagccgtattggcactattgtatcgacctgggcactgccgatctttatcaataattacggtatcagtaacacgatgctaatgggggcgggtatctcgctatttggcttgttgatttccgtagcgtttgccccggagactcgagggatgtcactggcgcagaccagcaatatgacgatccgcgggcagagaatggggtaatttgttcagatttctctcttttctgaatcaatattattgactataagctgcgtgaatatatgactacactttgtgggaaaacaaaggcgtaatcacgcgggctacctatgattcttataatttatgcgcatccatatccgcatcattcccatgcgaataaacggatgcttgaacaggcaaggacgctggaaggcgtcgaaattcgctctctttatcaactctatcctgacttcaatatcgacattgccgccgaacaggaggcgctgtctcgtgccgatctgatcgtctggcagcacccaatgcagtggtacagcattcctccgctcctcaaactttggatcgataaagttttctcgcacggctgggcttacggtcacggcggcacggcgctgcacggcaaacatttgctgtgggcggtgacgaccggcggcggggaaagccattttgagattggtgcgcatccggggtttgatgtgctgtcgcagccgctacaggcgacggcaatctactgcgggctgaactggctgccaccgtttgccatgcactgcacctttatttgtgacgacgaaaccctcgaagggcaggcgcggcactataagcaacgtctgctggaatggcaggaggcacatcatggatagccatacgcttattcaggcgctgatttatctcggttcggcggcgctgattgttcccattgcggtacgtctcggtctgggatcggttcttggctacctgatcgccggctgcattattggcccgtgggggctgcgactggtgaccgatgccgaatctattctgcactttgcagagattggcgtggtgctgatgctgtttattatcggcctcgaactcgatccacaaaggctgtggaagctgcgtgcggcagtgttcggcggtggcgcattgcagatggtgatttgcggcggcctgctggggctgttttgtatgttacttgggctgcgctggcaggtcgcagaattgatcggcatgacgctggcgctctcatcaacggcgattgccatgcaggcgatgaatgaacgcaatctgatggtgacgcaaatgggccgcagtgcctttgcggtgctgctgttccaggatatcgcggcgatcccactggtggcgatgatcccgctactggcagcgagcagtgcctcgacgacgatgggcgcatttgttctctcggcgttaaaagtggcgggcgcgctggtgctggtggtattgctggggcgctatgtcacgcgtccggcactgcgttttgttgcccgctctggcttgcgggaagtgtttagtgccgtggcgttattcctcgtgtttggctttggtttgctgctggaagaggtcggcttgtcgatggcgatgggcgcgtttctggcgggcgtactgctggcaagctcggaataccgtcatgcgctggaaagcgatatcgaaccatttaaaggtttgctgctggggctgtttttcatcggcgttggcatgtcgatagactttggcacgctgcttgaaaatccgttgcgcattgttattttgctgctcggcttcctcatcatcaaaatcgccatgctgtggctgattgcccgaccgttgcaggtgccaaataaacagcgtcgctggtttgcggtgctgttaggacagggcagtgagtttgcctttgtagtatttggtgcggcgcagatggcgaatgtgctggagccagagtgggcgaaatcgctgactctggcggtggcactgtcgatggcggcaacgccgattctgctggtgatcctcaatcgccttgagcaatcttctactgaagaggcgcgtgaagccgatgagatcgacgaagaacagccgcgggtaatcattgccggattcggtcgttttgggcagataaccggacgtttactgctctccagcggggtgaaaatggtggtgctcgatcacgacccggaccatatcgaaacgctgcgtaaattcggtatgaaagtgttttatggcgatgccacgcggatggatttactggaatctgccggagcggcgaaagcggaagtgctgattaacgccatcgacgatccgcaaaccaacctgcaactgacggagatggtgaaagaacatttcccacatttgcagattattgcccgcgcccgcgatgtcgaccactacattcgtttgcgtcaggcaggcgttgaaaagccggagcgtgaaaccttcgaaggtgcgctgaaaaccgggcgtctggcactggaaagtttaggtctggggccgtatgaagcgcgagaacgcgccgatgtgttccgccgctttaatattcagatggtggaagagatggcaatggttgagaacgacaccaaagcccgtgcggcggtctataaacgcaccagcgcgatgttaagtgagatcattaccgaagaccgtgaacatctgtcattaattcaacgacatggctggcagggaaccgaagaagggaaacatactggcaatatggcggatgaaccggaaacgaagccctcatcctaataaagagtgacgtaaatcacgctttacagctaactgtttgtttttgtttcattgtaatgcggcgagtccagggagagagcgtggactcgccagcagaatataaaattttcctcaacatcatcctcgcaccagtcgacgacggtttacgctttacgtatagtggcgacaattttttttatcgggaaatctcaatgatcagtctgattgcggcgttagcggtagatcgcgttatcggcatggaaaacgccatgccgtggaacctgcctgccgatctcgcctggtttaaacgcaacactttaaataaacccgtgattatgggccgccatacctgggaatccatcggtcgtccgttgccaggacgcaaaaatattatcctcagcagtcaaccgggtacggacgatcgcgtaacgtgggtgaagtcggtggatgaagccattgcggcgtgtggtgacgtaccagaaatcatggtgattggcggcggtcgcgtttatgagcagttcctgccgaaagcgcaaaaactgtatctgacgcatatcgacgcggaagtggaaggcgacacccatttcccggattacgagccggatgactgggaatcggtattcagcgaattccacgacgctgatgcgcagaactctcatagctattgctttgagattctggagcggcggtaattttgtatattagaattccggcatcactgatacgtgcagatatccgtgtatactagacgtataaattgtacaggagcacgagatcatgactgcaaaacgtaccacacaaagtgtgaccgtcaccgtcgaccgtgagttagtcaatcgcgctcgtgatgcaggcttaaatatgagcgccacccttacggttgcgctcaatgctgaacttaaaaaacatgcagcaacacgttggcgtgaagagaacgcagaagctatcgctgcgttaaatcaattggctgatgaaaccggatgtttctctgatgagtaccggagcttctagcgatgcaatttacggtataccacagtcgcggcaggaacgccgcgtttccctttgttattgatgttaccagcgacattgttggtgagattaatcgccgtatcgttattccattaacacctattgaacgatttagccgtattcgcccaccagaacggcttaacccaatccttttactggtagacggcaaagaatatgtgctcatgacgcatgagactgcaactgttccagttaacgcgctgggaacgaaattttgcgatgccagcgcgcaccgaacgttgcttaaaggagcattagattttatgctcgacgggatttaagacgctaccgcctctccctcactcaaatccttatgccggttcgacggctggacaaaatactgtttatcttcccagcgcaggcaggttaatgtaccaccccagcagcagccggtatccagcgcgtaaataccttccggcgtacctttgccttccagcgatgcccagtgaccaaaggcgatgttgtactcttcagcgacggggccaggaatcgcaaaccacggtttcagtggggcaggggcctcttccggcgattctttgctgtacatatccagttgaccgttcgggaagcaaaaacgcatacgggtaaaggcgttggtgataaaacgcagtcttcccagcccccgcaattccggtgaccagttatttggcatatcgccgtacatggcatcaaggaagaagggataggagtcactcgacagcaccgcttctacatcgcgcgcgcactctttggcggtctgcagatcccactgcggcgtgatcccggcgtgggccatcaccaactttttctcttcgtcgatttgcagcaaaggctggcgacgcagccagttaagcagctcgtcggcatccggcgcttccagcagcggtgtcaggcgatctttcggtttattgcggctgatcccggcaaataccgccagcagatgcagatcgtgattacccagcaccagacgtacgctgtcgcctaaggatttcacatagcgcagaacatccagcgaacccgggccgcgcgcgaccagatcgcccgtcagccagagggtatctttcccaggggtaaattctactttatgcagcaatgcgatcagttcatcgtaacaaccatgaacgtcgccaataaggtatgtcgccatattcttttaatgaatgagtgtgggaacggcgagtcggaatacgggaatgtcgatgctgaaagggacgccattttcatcgatcatttcgtagtgaccctgcatggtgcccagcggggtttcaatgattgcaccgctggtgtactggtactcttcgccaggcgcgataagtggctggacgccaaccactccttcgccctggacttcggtttcacggccattgccattggtgatcagccagtaacgccccaacaactgcactggcgctcgccccagattgcgtatggttacggtataagcaaaaacgtaacgttcattatcaggtgaagattgtgcctcaatgtagacgctttgaacctgaatacacactcggggcgaattgatcatcgttaactctcctgcaaaggcgcgttctccgccagatagttcgccatctggcaatattgcgcgacagagatattttccgctcgcatcgccgggtcgatccccattcccgttaacacctcggcgctaaacaggttgccgaggctgttacgaatggttttacgacgctggttaaaggcttcggtggtgatgcgactcaacacgcgaacatctttaaccgggtgaggcatcgttgcatgaggaaccaggcgcacgacggcggaatccactttgggtggtggtgtaaaggctgacggcggtacttccagcaccgggatcacgttgcaatagtattgcgccatgacgcttaatcgaccatacgctttgctgttcggtcctgcaaccagacgattcaccacctctttttgcaacataaagtgcatgtcggcaatggcatcagtatagctaaacagatggaacatcaacggcgtggagatgttataaggcaggttgccgaaaacacgcagcggctgacccattttcgcggccagttcgccaaagttaaaggtcatcgcatcctgctgataaatcgtcagtttcgggcctaagaatggatgcgtttgcagacgtgccgccagatcgcggtcaagttcgatgaccgtcagctggtccagacgttcgccgaccggttcggtcaatgccgccagaccggggccgatttcgaccatcgcctggcccttctgcgggttaatggcagaaacaatgctgtcgatcacgaactgatcgttgagaaagttttgcccgaagcgtttacgggctaagtggccctggtggactcgattattcattgggtgttaacaatcattttgatggcgagattaagcgccgtaataaaactgccgacatcggctttaccacgtcccgccagttcaagcgcggtgccgtggtccactgatgtgcgaataaagggcaggcccagcgtaatgttcacaccgcgcccgaagccctggtattttagcacgggaagaccctgatcgtggtacatcgccagcacggcgtcggcgttatcgagatatttcggctgaaacagggtatcggcaggcagcggcccgttgagtttcatcccctgttcccgcagctcgttgagtaccggaataatggtgtctatctcttccgtacccatatgaccgccttcgcccgcgtgcggattcagcccgcagaccagaatgcgcggttcggcaataccaaatttggtccgcaaatcgtgatgcaaaatagcaatcacttcgtgcaaaagggcaggggtgatagcatctgcgatatcgcgcagcggtaaatgcgtcgttgccagcgccacgcgaagttcttcggtcgccagcatcatcaccacttttttcgcctgcgaacgctcttcgaaaaactcggtatgaccggtaaacggaatgcctgcgtcgttaatgacgcctttatgcacggggcctgtgatcagcgcagcaaattcaccgttcagacagccatcacacgctcgcgccagcgtttccactacatagtgcccattttcaaccgctaactgccccgcagtgacagattcacgcagcacgacaggaagtagcgttaatgtgcccgcagtttgcggttgtgcaggggagttgggggaataagggcggagggtgagcggcaaaccgagcatcgctgcccgatcggtaaggagagtggcatcggcacaaacaaccagttcgaccggccactcacgctgtgcaagctggacaattaagtccgggccaatcccggcgggctcgccgggagtgatcacaacacgttgggttttaaccattagttgctcaggattttaacgtaggcgctggcacgttgttcctgcatccagcttgctgcttcttccgagaacttacggttcatcagcatgcggtatgcacgatctttctgtgccgcgtcggttttatcgacattacgggtatccagcagttcgattaaatgccagccgaatgaagagtgaaccggtgcactcatttgacctttgttcaggcgggtcagggcgtcacggaaggccggatcgaaaatatctggtgtagcccagccgagatcaccgccctggttagcagagcctggatcctgagagaactctttcgctgcggcagcaaaagtcgttttaccactcttgatatcggcagcaatctgttccagtttcacgcgggcctgttcgtcagtcatgatcggcgacggtttcagcagaatatggcgagcatgaacttcggtcaccgagatatttttgctttcgccgcgcaggtcgttaactttcagaatatggaagccaacgccggaacgaatcgggccaacaatgtcgcctttcttcgcggtgcttaatgcctgggcgaagatccccggcaactcctgaatacggccccagcccatctgtccgccgttcagcgcctgctggtcggcagaatgagcaatcgccagcttaccgaaatcagcgccgttacgcgcctgatcgacaatcgcgcgcgcctggctttccgcttcgttcacctgatcagaggtcgggttttccggcagtgggatcaggatgtggctcaggttcagctcagtgctggcgtcgttttggttacccacttgctgcgccagggattcgacttcctgcggcaggatggtgatgcgacgacgcacctcgttgttacgcacttcagagataatcatctctttgcggatctggttacgataggtgttgtagttcagaccatcgtaagccagacggctgcgcatctgatccagcgtcatgttgttctgtttcgcgatgttagcaatcgcctgatccagctgctcatcggagattttcactcccattttctgccccatctgcaggatgatttgatccatgatcaaacgctccatgatttggtggcgcagcgtcgcgtcatcaggaagttgttgccttgcctgagcagcgttcagttttaccgactgcattaatccatcaacgtcgctttccagcacgacgccgttattgacgacggctgcgactttatcgactacctggggggcagcgaaactggtattcgcgatcatggcgataccgagaagcagcgttttccagttcttcatactttttccatttcaattaaccgcactgcggattacgtggtaaatcaacaaatcacaaagtgttttgatacggcagaatgttcgaacgcagcatctcttgcgtacccagaccgtagttggagctcaggccgcgaagttcgatgttaaagccgattgcgttgtcatataccgcatgttgtttatcgttatcccaaccgttcagcttccgctcgtaaccgacgcgaatcgcatagcagcaggagctgtattgcacacctaacatagagtcggcttgcttgttcgcattggtgtcgtagtagtaggccccaacaatggaccaacgatcggcaattggccagctggcgacggcacctacctgcgaaataccattcttatattgctcagcagtggaatagtacttaggcagcgttgcctgaatatattccgggctggcgtaacggtaattcagctgtaccagacggtcttcatcccgacggtattcaatgctggagttactggtcgctacgttatccagacgtgtatcgtactgaatcccgccacgcaatccccaacgatcagagatgcgccagtaagtatcgcctgcccataccagtgagcccgttttgtcgtcattctcccatgttatgttgtcatcgccagtgcgagactccgtgaaatagtagatttgaccaacggaaatattaaaacgttcaacggcagcatcatcatatatgcgagatgtgacaccggtcgtcacctggttagcggaggcaatacggtcaagaccgccgtaagtccggtcccggaacaggccggagtagtcagattgcagcagcgacgagtcgtagttatagattttgctctgatcgcgatatggcacatacagatactgcgcgcgtggttccagtgtctgggtatagcccggcgccagcatttccatatcacgctcgaagaccattctaccgtctaccttgaactgcggcattacacggttagcggactctgccagcttggtcgtgtttctggagttataccagtcaagattggtttgctgataatgggttgccagcaacttcgcttcagtattgatgctgccccagttattagagagcggcagattgatggtcggttccaggtgaacacgagtcgcctctggcatgtcatctctggtgttaacaaagtgcaccgcctggccgtaaattcgcgtatcgaaaggaccgacatcgttttgatagtagttaacgtctaactgcggttctgccgagtagctactggtgttctgctcgctgaagacctggaactgcttggttgaaacggtggcattgaagttttgcaccgcatagccaacgctgaatttttgcgttgcatagccgtcggtactggaaccgtacttgttatcgaaatcattgaagtagctaggatcgctgaccttggtgtagtcgacgttgaaacgccacacctgatccatgaccccggagtggttccagtagaataaccaacgacgtgaactgtcatcgttcgggtgttcatctttatagactttatctgaaggcagatagtccagttccatcaagccagcgcccgcctgggagaggtagcggaattcgttctcccacatgatattgccacgacgatgcatataatgcggcgtgatggtggcatccatatttggcgcgatgttccagtaatatggcaggtagaactcaaagtagttggtggtggtgtacttggcgttcgggatcaagaaaccagagcgacgtttgtcacccaccggcaactgcaaataggggctataaaagatcggtaccggacccaccttaaagcgggcgttccagatctccgcaacttgttcttcgcggtcatgaataatttcgctacctaccacgctccaggtgtcagaacccggcagacaggaggtaaagctaccgttatccagaatggtatagcggttttcgccacgttgtttcatcaggtccgctttaccgcggccctggcgacccaccatctggtaatcaccctcccagacgttggtatctttggtgttcagattcgcccagcctttcggccctttgaggatcacctggttatcgtcgtaatggacattaccgagcgcatcaacggtacgtaccggctccggttgtcctggtgcctctttttgatggagctgcacttcgtcggcctgcagacggctgttaccctgcatgatatccacgctgccagtaaacacggcgtcatccgggtagtcccctttcgcgtggtcagcattgatagtcacgggtaagtcattggtatcgccctgtaccagaggacggtcatagcttggcacgcccaacatgcactgtgaggcgaggtcggctgccagtccctgttgactataaagggcggtggcaatcatggtggccaggagagtggggatacgttttttcatacgttgattttattgttccatcatcggtaacgttgcgcgtgacaaacggtcagagactaacgtactcgtcatctctacgctagtgttaatcctgtccgaatagcgtctgtggtgttaggcacggcattgaatgacaggtatgataatgcaaattataggcgatgtctcacaatagaccgcagccagaaatgggtaaaagcgcctttatattgtgggagatagccctgatatccgtgtgtcgatttggggaatatatgcagtattggggaaaaatcattggcgtggccgtggccttaataatgggcggcggcttttggggcgtagtattgggcctgttaattggccatatgtttgataaagcccgtagccgtaaaatggcgtggttcgccaaccagcgtgagcgtcaggcgctgttttttgccaccacttttgaagtgatggggcatttaaccaaatccaaaggtcgcgtcacggaagctgatattcatatcgccagccagttgatggaccgaatgaaccttcatggcgcttcccgtactgcggcgcaaaatgcattccgggtgggaaaatcagacaattacccgctgcgcgaaaagatgcgccagtttcgcagtgtctgctttggtcgttttgacttaattcgtatgtttctggagatccagattcaggcggcgtttgctgatggttcactgcacccgaatgaacgggcggtgctgtatgtcattgccgaagagttaggcatctcccgcgcccagtttgaccagtttttgcgcatgatgcagggcggtgcacagtttggtggcggttatcagcagcaatctggcggtggtaactggcagcaagcgcagcgtggcccgacgctggaagatgcctgtaatgtgctgggcgtgaagccgacggatgatgcgaccaccatcaaacgtgcctaccgtaagctgatgagtgaacaccatcccgataagttggtggcgaaaggtttgccgccagagatgatggagatggcgaagcagaaagcgcaggaaattcagcaggcctatgagctgataaagcagcagaaagggtttaaataagtttcaacgtgtaggcctgataagacgcggcccgcgtcgcatcaggcaatcggcgcaaaattgccggatgcggcgtgaacgccttctccggcctaccgaacttcgccagcgtgactattaaaaatccgctggtgctttaaatgtcatactattgccatacgccggatgggtaatcgtcagcatctctgcatgtagcaacaaacgcggtgccattgctctcgcttctggtgatgcataaaaacgatcgccgagaatcggatgacccagcgccagcatatgcacacgcagctgatgcgaacgcccggtaatcggttttaacaccactcttgccgtgttatccgccgcatattccaccacttcatactccgtctgcgcaggtttacctgtttcgtaacagactttctgtttcgggcggtttggccagtcgcaaatcagcggcagatccaccagaccttccgcaggggatggatgcccccagacgcgggccacatactgttttttcggctcgcgctcgcggaactggcgttttaactcccgctccgcggctttggtcagcgccactacaatcacgccgctggtagccatatccagacgatgcaccgattctgcctgcggataatcacgctgaatgcgcgtcatcacgctgtctttgtgctcttccagacgacccggcacagacaacaaaccgctcggcttgttgaccaccataatatggtcatcctgatacaggataaccaaccagggttcctgcggcggattgtagttttccatccccatcttcggctccgttactgatgcgttacaacgatcaaacgcagggcatccagacgccagcctgcctgatccaggctttccattacctgctgacggttgctctcaatggcggtcagttcgtcgtcacgaatgttcgggttaactgcacgcagcgcttccagacgagacagctcggcagacagtttttcgtcggcttcgttacgcgctgcatcaatcaatgcacgggcagatttctcgatctgcgcttcccccagctgaaggatagcgtgaacatcctgctgcacggcgttaaccagcttgctgccggtgtaacggttaaccgcgttaagctggcggttaaaggtttcaaactctacctgcgccgccaggttgttgccgtttttatccagcagcatacgtaccggcgtcggtggcaggaagcggttgagctgcaactgcttcggagcctgggcttcaaccacataaatcagttccaccaacagcgtacctaccggcaacgctttgtttttcaacagtgaaatcgtgctgctaccggtatcgccagaaaggatcagatccagaccgttgcggatcagcggatgctcccaggtaataaactgcgcatcttcacgcgccagcgccacttcacggtcgaaggtgatggtgattccatcttccgacaggccagggaagtccggcaccagcatatgatcggacggcgtcagcacgattatgttgtcgccgcgatcgtcctgattgataccgataatatcgaacaggttcatggcgaaggcgatcaggttggtatcgtcatcctgctcttcaatgctttctgccagtgcctgggctttttcgccaccgttggagtggatctccagcaggcggtcacgcccctgttccagttgtgctttcagcgcttcatgctgctcgcggcagtttttgatcagatcgtcaaagccttcggtctcatccggcgaggccagatagttaatcaaatcgttgtacacgctatcgtagatagtgcgtccggtcgggcaggtgtgctcgaatgcatccagaccttcgtgataccagcgcaccagcaccgactgagccgttttttccagataaggcacatggatctgaatatcgtgcgcctgaccgatacgatccagacgaccaatacgctgctccagcagatccgggttgaatggcaggtcaaacatcaccatgtggctggcgaactggaagttacgtccttcagaaccgatttccgagcacagcagtacctgtgcgccggtgtcttcttcggcaaaccaggcggcagcgcggtcacgttcgataatcgacatgccttcgtggaacactgcggcgcgaataccttcacgttcgcgcagtacctgctccagttgcagcgcagtggccgctttagcgcagatcaccagcactttctgagagcgatggctggtcaggtagcccatcagccattcaacgcgcggatcgaagttccaccaggtggcgttatcgccttcaaattcctgataaatacgctccggatagagcatatcgcgagcgcgatcttccgcacttttacgtgcgcccataatgccggagactttaatagcggtctgatactgcgtcggcagtggcagcttaatagtgtgcagctcgcgtttcgggaagcctttcacaccgttacgggtgttacggaacagcacgcggctggtaccgtggcgatccatcagcatcgaaaccagttcctgacgggcgctctgggcatcttcgctgtcgctgtttgctgcttgcaacagcggctcgatatcctgctcgccgatcatctcaccgagcatgttcagttcgtcattgctgagtttgttaccagccagcagcatggcaacggcgtccgcaaccggacgataatttttctgctcttcaacgaattgcgcaaaatcgtggaaacggttcgggtccagcagacgcagacgggcgaagtggctttccatccccagctgttccggggttgcggtcagcagcagaacgcccggcacgtgctctgccagttgttcaatggcctgatattcacggctcggcgcatcttcgctccacaccaggtgatgcgcttcatcgaccaccagcaggtcccactcggcttcacagagatgttccagacgctgtttgctacgacgggcaaaatccagcgagcaaatcaccagctgttcggtgtcgaacgggttgtaagcatcgtgctgagcttcggcataacgctcatcatcaaatagcgcaaagcgcaggttgaaacggcgcagcatttctaccagccactgatgctgtaaggtttccgggacgataatcagcacacgttcagcagcgccagagagcagttgctgatgcaggatcatcccggcttcaatggttttccctaaacccacttcgtcagccagcaggacgcgcggcgcgtggcggcgaccaacatcatgagcgatgttgagctggtgcgggatcaggctggtacgctgaccgcgcaggccgctgtacggcatacggaactgttcgctggaatacttacgcgcgcgataacgcagcgcaaagcggtccatacggtcaatctgcccggcaaacagacggtcctgcggtttgctgaacaccagtttgctatcaaggaaaacttcacgcagggctacgccggactcttcagtatcaaggcgagtaccgatataggtcagcaagccattttcttcttttacttcttcgacttgcatctgccagccgtcatggctggtaatggtatcaccagggttgaacatcacgcgggtcacgggggaatcactgcgtgcgtacagacggttttcaccagtagatgggaaaagtaaagtgacagttcgcgcatccaccgcgacaacggctccaagtcccaattcgctttctgtatcgctgatccagcgttgaccaagtgtaaaaggcatatgtgttcggctctatatctttaattgcaggcaataaccacccgctaccgtgcttatgaggtagtggtgttattcaggtccaggaatggaaagggcgctatggtactggatggcaaagcattcgtcacgcatcaaaatggtatctggcgaactctttttttgctcaaaatagcccaagttgcccggtcataagtgtagcaaaattatcctcaataaaagggagtattccctccgccacgggttgtagctggcgggtcagatagtgttcgtaatccagtggtgaacgttggtagtccagcggctccgggccgttggtggtccatacgtacttaatggtgccgcggttctgatattgcaaggggcgaccgcgcttatggttttcttcatcggcaaggcgagcggcgcgtacatgaggcggaacattacgctgatattcgctcagaggacggcgaaggcgtttacggtaaaccagctgcgtgtccagttcgcccgccatcagcttgtcgatggtttcgcgcacgtattcctgatatggctcgttgcggaagatacgcaggtacagctcctgctgaaactgctgggccagcggcgtccagtcggtgcgcacggtttccagccctttaaacaccatccgctgtttgtcgccctcctgaatcagtccggcgtagcgctttttgctgccggtatcggccccgcgaatggttggcatcagaaaacggcagaaatgggtttcatactccagttccagtgcgctggtcagccgttgtttttgcagcgtttccgcccaccaggcgttaacgtgctgcaccagtgcacgaccgattttcgctgcttcttcttccgaatgtgcacctttcagccagacaaacgttgagtcggtatcgccgtagataacatcatagccctgcgcttcaatcaacgttttggtttgccgcatgatctgatgaccacgcatggtgatcgacgatgccaggcgtggatcgaagaaacggcaggcggtggtgccgagcacaccataaaaggcattcataatgatcttcagcgcctgcgaaagcggcttattactctgacgtttggcttcatcgcgcccgtgccagatgttagtcacaatctccggcaggcaatgtttctcccgtgagaaccaggcatcgagaaaaccttcggtactgtgctctggatcaggctgcgccatgccttccaccagtccgacgggatcaatcagaaaggtgcggatgatcgacgggtacaggcttttgtagtccagcaccagcaccgaatcataaagcccaggtcgcgaatccatcacgtagccgccagggctggcgtgcggcggcacttcgccgagattaggcgcgacataaccagcgcgatgcatacggggaaaatagagatgaccaaacgctgccaccgaaccgccgtgtcgatctaccggcaggccgttcaccgtcgcccgttcgagcaaaaacggcatgatttcagttttgtggaagatctgcgtcaccagctcgcaatctttcaggttataagttgccagcgcaggcttatcttcggcgaaacggcggtcaatttcgtccattcgatcccacgggttatcgatagattttccttcgcctaataactcctgagcgacggtttccagcgagaatgaagagaaattccagaacgcggatttcagcgcctcgataccgtcgataatcagtcgccctttggcctgagcaaaaaagacgccgtttttaaagccgtgctcgcgccactccaactcgctgttatcacgccccagacgcagcggaatacggtaacgctcggcatgtttttgcagcattcgcagatcgaactgcaccacgttccaaccgatgatcacatcaggatcatgagtcgcaaaccaggcgttaagtttttccagtagcagcgggcggctggcgacgtattccagttcaaaatcgagcgcggaggcgtcgccattctctggccccagcatataaacgatacgctgcccgcaaccttccaggccgatgcagtacagctcaccgtggcgggtggtttcaatatcaatagaaacccacttgagcggcggacgatagtcgggatgctgtttcagacgggcattaacgatagcgccgttgcgcatatcaccctcgacccacactggcgaggtgataaaccgctccatcagatagcgttctggcgggcgcacatcggcctcgtagacggtaacgccagcttcacgcaggcgcttttcgtaattcatcaactggcgatgggcgcgacagtaaaggccatacaccggctggcgatgaaaatcctttaacgccagcggcgtcaggcgaaagccttgctcaccctgcaaaatatgctgggcgcggggaacctgatcggcgggaataaacgccacggactcttgcggcgcaagcgtaacctgcaacggcccgttgtccgtcgctaaccaaaaggaaacttcggttccttgcggggtgtcccgccagtgtcgggttaagataaaacctgcctgcgccacgctgaaaatccaataaaaaaccaggcttgattatagcctggtttcgtttgattggctgtggttttatacagtcattactgcccgtaatatgccttcgcgccatgcttacgcagatagtgtttatccagcagcgtttgctgcatatccggtaactgcggcgctaactgacggcagaatatccccatataagcgacttcttccagcacgatggcgttatgcaccgcatcttcggcgttttttccccatgcaaatgggccgtgagaatggaccagcacgccgggcatttgcgctgcatcgataccctgtttttcgaaggtttctacgatgacgttaccggtttcccactcatattcaccgttgatttctgcgtcggtcattttgcgggtgcagggaatgggaccgtagaaatagtcggcgtgggtggtaccggttgccggaattgactggcccgcctgcgcccagatggtggcgtggcgcgagtgtgtgtgcacaatgccgccaatagacgggaatgcctgatagagcagtcggtgagttggcgtgtcggaggagggctttttcgtaccttcaaccacttcaccggtttcgatgctgaccacgaccatatcgtcagcggtcatgatgctgtagtcgacgccggaaggtttgatcaccaggacgccgcgcccgcgatcaacggcgctgacattgccccaggtgagcgtgaccaggttgtgttttggcagcgccaggttggcttctaagacctggcgtttgagatcttctaacatgttgactccttcgtgccggatgcgctttgcttatccggcctacaaaatcgcagcgtgtaggcctgataagacgcgtcggcgtcgcatcaggcggtgaatgccggatgcgctttgcttatccggcctacaaatccggaacgcgtaggcctgataagacgcgccagcgccgcatcaggcggtgaatgccggatgcgctttgcttatccggcctacaaatccggaacgcgtaggcctgataagacgcgtcagcgtcgcatcaggcgttacatacctgatgcggctacttagcgacgaaacccgtaatacacttcgttccagcgcagcgcgtctttaaacgctggcaggcgggtgtcgttatcaatcaccgtgatttcaatgtcgtgcatctcggcaaactggcgcatatcgttgaggttcagcgcatggctgaagacggtatggtgcgcgccaccagcaaggatccacgcttcggaagcggttggtagatccggttgcgctttccacagcgcattcgccaccggcagtttcggcagggagtgcggtgttttcaccgtgtcgatgcagttaaccagcagacggtaacgatcgccgagatcaatcaggctggcgacaatggctggaccggtttgagtgttgaagatcaggcgggcaggatcgtctttaccgccaataccgagatgctgaacgtcgaggatcggtttctcttccacagcgatcgacggacagacttccagcatatgggagccgagtaccaggtcattacctttctcgaagtgataggtgtagtcctccataaaggaggtgccgccctgcagaccggttgacatcaccttcatgatgcgaagcagggcggcagttttccagtcgccttcgcccgcaaagccgtagccctgctgcatcagacgctgtacggccagacccggaagctgtttcaggccgtgcaaatcttcaaaggtagtagtgaaagcgtggaagccaccttgttccaggaaacgcttcatccccagctcaatacgcgccgcttccagcacgttctgtcgtttttcgccgtggatttgtgtggcaggtgtcatggtgtagcagctttcgtactcatcgaccagcgcgttaacatcgccgtcgctgatggagttcaccacctgcaccagatcgccaaccgcccaggtattgacggagaaaccgaacttgatctgtgcggcaactttatcgccatcggtgaccgctacttcacgcatgttatcgccaaaacggcagactttcagatgacgggtatcctgtttagagaccgcctgacgcatccaggagccgatacgctcatgtgcttgtttatcctgccagtgaccggtaacgacggcatgttgttgacgcatacgcgcgccgatgaagccgaactcgcgaccgccatgcgcggtctggttcaggttcataaagtccatgtcgatgctgtcccacggcagcgccgcgttgaactgggtgtggaattgcagcaacggtttgttgagcatggtcaggccgttgatccacattttggccggggagaaagtgtgcagccacactaccagcccggcgcaacgatcgtcgtaattcgcgtcgcggcaaatagcggtgatttcatccggcgtggtgcccagcggtttcagcaccagtttgcagggcaacttcgcttctgtattcagtgcattaacaacgtgttccgcatgttgcgtcacctggcgcagagtctccgggccgtaaagatgctggctgccaattacaaaccacacttcataattatcaaaaatcgtcattgtcgtgtccttatagagtcggaacggcctgggcagcctgtgccggggcggaagttggaagatagtgttgttcggcgctcatcgcccattgctgatagcggcgataaagctgttcaaagcgttgtgcctgttcgctgcacggttgcagggttttctctaccgcactggccattttttgctgggctgaggggatatcggcgtgcacttttgcggcgacggcagcgaaaatcgccgcaccgagcgcgcaacattggtcagaagcaacaatttgcagcgggcgattcagcacgtcgcagcaggcctgcataatgacctggtttttgcgcgcgatgccgcccagtgccatcacgttattgacggcgatcccctgagcggtgaagcactccataattgcgcgtgcgccaaaggcggtggcggcaatcaaaccgccgaacagcagcggagcgtcggtagcgaggttcagatcggtaatcacccctttcaggcgttggttagcgttcggtgtgcggcggccgttaaaccagtcgagcaccaccggcaggtgatccagagacggatttttggcccatgcttcggtcagcgccggaagcagttgtttctggctggcgttgatttgctctttcagttccggatgctgggcggcaagctgttccagcggccagccgagtacgcgaccgaaccaggcgtagatatccccaaacgccgattggcctgcttccagaccgataaatccaggcaccacgctgccatcaacctgaccgcaaatacctttcactgcccgctcgccaacgctctgtttgtcggcaatcagaatgtcgcaggtggaagtaccgataacttttaccagtgcgttaggctgtgcgcctgcgccaactgcgcccatatggcagtcaaacgcgccgccggaaatcaccacgctttcaggcaggccgagacgctgcgcccattccgggcataaggtgcccaccggaatatcggcagtccaggtttcagtgaacagcggggaaggtaaatgacggttgaggatcgggtccagctcatcaaagaaactggctggcggcaggccaccccagctttcgtgccatagagatttatgcccggcgctgcaacgtccgcgacgaatatcctgcgggcgggtggtaccggaaagcagagctggcacccagtcgcacagctcaatccacgatgcggcagattgtgccacggcgttgtcctggcgagttatatgcaggatttttgcccagaaccattcgctggaataaataccgccaatatagcgggagtagtcaacgttgcccggcgtgtgacataagcgggtaatctcttccgcttcttcaaccgcggtgtggtctttccacaatacgaacatcgcgttcgggttttcggcaaactccgggcgcagcgccagcacgttaccgtcggcgtcaatcggtgcgggcgtcgagccggttgtgtcaacgccaatcccgaccacagcttcgcgctgttcgacgctaagctctgcaagcacagttttcagcgccgcttccattgactcaatgtagtcacgcggatgatgacggaactggttattcggggcatcacaaaattgcccgttctgccaacggggataccactctacgctggtggcgatctcttcaccggtggcgcagtccaccgccaaagctcgcacagaatcactgccaaaatcgaggccaattgcaatcgccatcgtttcactccatccaaaaaaacgggtatggagaaacagtagagagttgcgaaaaaaagcgtcaggctggatccgctaatcttatggataaaaatgctatggcatagcaaagtgtgacgccgtgcaaataatcaatgtggacttttctgccgtgattatagacacttttgttacgcgtttttgtcatggctttggtcccgctttgttacagaatgcttttaataagcggggttaccggttgggttagcgagaagagccagtaaaagacgcagtgacggcaatgtctgatgcaatatggacaattggtttcttctctgaatggcgggagtatgaaaagtatggctgaagcgcaaaatgatcccctgctgccgggatactcgtttaacgcccatctggtggcgggtttaacgccgattgaggccaacggttatctcgatttttttatcgaccgaccgctgggaatgaaaggttatattctcaatctcaccattcgcggtcagggggtggtgaaaaatcagggacgagaatttgtctgccgaccgggtgatattttgctgttcccgcctggagagattcatcactacggtcgtcatccggaggctcacgaatggtatcaccagtgggtttactttcgtccgcgcgcctactggcatgaatggcttaactggccgtcgatatttgccaataccggtttctttcgcccggatgaagcgcaccagccgcatttcagcgacctgtttgggcaaatcattaatgccggacaaggggaagggcgctattcggaattgctggcgataaatctgcttgagcaattgttactgcggcgcatggaagcgattaacgagtcgctccatccaccgatggataatcgggtacgcgaggcttgtcagtacatcagcgatcacctggcagacagtaattttgatatcgccagcgtcgcacagcatgtctgcctgtcgccgtcgcgtctgtcgcatttgttccgccagcagttagggattagcgtattaagctggcgcgaggaccagcgcatcagtcaggcgaagctgcttttgagcaccacccggatgcctatcgccaccgtcggtcgcaatgtcggttttgatgatcaactctatttctcgcgagtatttaaaaaatgcaccggggcgagtccgagcgagtttagggcaggttgtgaataataagaaagaagggggggaacccccttgctttcttcatctgacgttatttatatatttcacgggggattaattttagttatttttagttgaatcgttttacctgaattattttttttcttgataaaatatcgacaacgatttctttttgtaaaaataaaacgaaggcttatgtatcgggatacccatcatgaacatattgtccggttgcatcaggagaatatatcaagcggtttgttcatcgtaggaacaccacattgagcggttatggcaggcacttcacgccaccataaatgccgttcgatgtggcagttgttgaaaaaagtacggcattctatgaaaaacgccagttactccctcagaggagaacatggtctggcaaaagtgtagcggcatcaggcgcagctatctttgtaaattcattcataaaatgaattgtatacaaaaaaatattgaaaaataatatttttccttattgatattatttgctatacgttttttttgaggggagattgtgatgagcaaacgtaacgatattactgatggaatatttgcaacaacgaaaaagtatggattagtttataccgaagagttaggttggatcgatttggggcatgctcagggacaagatgccagaatattaaaaagaaaattggagcaagaacatttttcaacatattacgatgaatttcatgattggtattttcctgttgattatcatcaggaaatgggaattcggaaaaaaatattaggagtagatcttacatttcataccggtgtttatacgaaggttatggttcgttcatgtctttcacccactcttaaagcaagagttgccttaacgttaatgtatggaactgcgaagaggtttgaagcatggcaaaactcatttatttttaactggtatactgatagcggatttagtgcagaagatttagtctcagacttgattggtttttatcgtgtatttggaacaggccccgatccacttttattggcaaaacctttatcttacacaaaagccttacaaatatgggatacatatggagcgccagggaattttaaaaatactgagtttacgccattcttatttacaacccatcctccttttaaaaaaaatcaactaataaaaaagaagcttccagaatggttaaattatataaagccattagatgagtctttttcaacattgttatataatcaatataataatagacctgttactaattattataaagataaaaacagaataaatcatgagttgtatagttcattatcaagttcgggagctataaagttttcagaatctccctttgaaagaccgctttttcttttcttaaaccctcattatccgcacaggtcgtgagtagagatgtcaaaatatatttatattttattatcatttttagttttattctttatatttttctatgcttatatctcattgatgtcaaaggaacatcactatacacagcatgaactttccccatttttcctttatacgccagagagtttgcgaaatttgccaaacatatcaaacgtagccgagtatagctattactataatgttgatgatatgcaaacaagagtgattgttacatggcgaaatatagataacatttttcttcagaaagcaaagctaatagattttttgaaaagaatgggaccgagtctacaaaacgattgtatatggttttttcatgataaaagtgattatgcaaataatttccagcgttattgcatcattgagcaccgtgattctctgcaggtggaatattttgagactatcgaatgataggcagagggtgtcttttgtgccggttgtgaagaaaaagtgaatgatgtagccgtcaagttgtcataattggtaacgaatcagataattgacggcttgacggagtagcatagggtttgcagaatccctgcttcgtccatttgacaggcacattatgcaagcattgctggaacactttattacccaatctaccgtgtattcattgatggcggtgttattggtggcctttctggagtcgctggcgctggtcggtttgattctacccggtacggtgctgatggcggggctgggagcactgattggcagcggtgagttaagtttctggtacgcctggctggcggggattattggctgcctgctgggcgactggatctccttctggctgggctggcgttttaaaaagccgttgcatcgctggtcatttctgaagaagaacaaagcattactcgataaaaccgaacatgcgctgcatcagcacagcatgttcaccattctggtcggtcgttttgtcggcccgacgcgtccgctggtgccaatggtggcgggaatgctggatctcccggtggcaaaatttattacgccgaatattatcggctgcttgctgtggccaccgttttacttcctgccggggattctggcgggtgcggcgatcgatattcctgccgggatgcagagcggtgagtttaaatggttgctgctggcaacagcggtgtttttgtgggttggaggctggctgtgctggcggttatggcgcagcggtaaagcgactgaccgtttgagtcattatttgtcccgcggtcgtttgttgtggctgacgccgttgatttctgccatcggcgtggtggcgctggtggtgttaattcgccacccgttgatgccggtgtatatcgatattttgcgtaaagtggttggggtttagaggatagccttgtgcgggttgcctgatgcgacgcttgccgcgtcttatcaggcctacaaaacgcactacctgtaggtcggataaggcgttcacgccgcatccgacagtgcatattaacctttaattcccaacagcgccgaagcactcgccttaccgctcaacaactcatcggtcttaccctgccaggcgatacgcccgtcggcgaccaccaccgagcgcgtggcgatccgcgccgcatcttccacactgtgcgacaccatcaatagcgtcattttttgctgttggcagctcgtgctcaccagcgtcagcatctcctgacgtagcgccggatcgagcgcggaaaacggttcatcgagcaataaaatgggctgttcgcgtaccagacaacgcgctaacgccacgcgctgtcgttgaccgccggaaagctcgccaggtaaccgcgccattaaattatcaatccccatctggtgggcaatcgcgtgcattttcttctgctgcgccgcatttagtttcaaccccggatttagccccagcccgatgttctgcgcgaccgtcaggtggctgaacaggttgttctcctgaaacagcatcgacaccggacggcgtgacggcggcgtcgtggtgtgatctacgtcgtcgatagtcagcaaaccgctggctggcgtcagaaaaccggcgatcaaattaagcagggtacttttacctgcgccgcttggcccgaggatcgccacctgctcgccgcgttccaccgttaagctaaaacgcatcggcaaatggtggtaaagccaggtgatatcagtcagttttaacatttcgccccggtattttttcaatcacggtaaacagcagaaaacagagcagcagcagaattaacgcggtgaccgcgccgtcctggctgcgataggagccaatttgctggtagagataaaacggcagggtacggaaatcatcgttaccgaacaatgccaccacgccaaaatcaccaatcgacagcacacaagcaaaggccagcgcctgcgccagtggacgtttcagggcgcgcagctccaccacttttaagcgtgaccagccttcaatgcccagcgactgacacaacatgctgtagcgggcggtgatatcgcgcatcgggttttccagcactttcagcgcataagggattgccattaacgcattggtgaaaatcacaatgccgtcagcagattgtggcaggccgatagtgttgttgagcagtaaaaagaagcccgtagccagcacaatccccggcatggcgaggatcaacatgccgctcatctccagcgcctgacccgccagcattttctgccgcgcccgaagttcgcgactgctccatagcagcatcatggtcagcactacgcacaatacgcctgccgccagcgcaatacgcaacgaggtccacagcgcctgccacagcaccggttgtgccagcacttccggcaactggcgatttaccccatcgacgatcaccgccagtaacggtggcagcaacagcagcagcgccagcacaattaacgccgtgtcgcaaatgtgactatgcagacgatcgtccgggtcgcgccagccttgcagcagtgtggtaccaggcgcaatggccttactcaatcgctgactcaacagcaccagcccgaggcagcacaccatctggatcagcgccagcattgccgcgcgggcaggatcgtagtcgtaactcagcgcctgatagattgccagctcgatagtggtcgcctgcggaccgccgcccagcgatagcacggtggcgaagctggcgaaacagagcataaagattagtgcggcaaccggcggaatttgtcgccgtaaccacggccattcgacgaagcggaagaagtgacagccgcgcatcccaagctgggcggcaagctgacgttgttcgccgggaatgttttccagtgcctggagtaataaacggctagccatcggcagattaaaaaacacatgggccagcaaaatgccttgcaggccgtagggcgaaaaggtccactccagaccaagtgattgccagagcgaggccagccagccctggcgaccatagacgctaagaatgccgaaaacggcaaccagcaccgggaggatcaaggtcattgcgcacagacgcaacagcatctgtcgcccaggaaagcgcctgcgatagagggcgcgggcgaggaatattgcgggtacgacagagagcagcgccgagagaaacgcctgccagaaggagaagcgcaccacatgccacaggtagctgtcctgccagactgacacccagtcaccctgcggcgcgttccaccacagggcgagaaacgccgccagtgcaaccgctaccaccagcgtggcggcgcttacgcctggaattaaccagccgggaattaacggctgacggcgcgttgccattcgctaatccatgcctgacgttgtgccgccacttcggcgggtgtgaactctagtgtggtggctggtttggtcaattgttcaaatcctgcaggcagagtgacgtttgctaccggatacatccagttgccggttgggatcgcattctgaaaagccggagaaaccataaactggaggaatttttgcgccagctctggctgcttgctggcagcggtgcgggcggcaacttccacctgcagatagtgaccttcgataaagtttgtggcggcgtagttatctttcttctcttcgagaatgtgataagccggagaggtggtgtaactcagtaccagatcgctttcgccttttaaaaacaggccgtaggcttcgctccagcctttggtgaccgtgacagttttcttcgccagtttctgccaggcttgcggggcgttatcgccatagactttttgcatccatagcaacagacccagccccggtgtactggtacgtggatcttcataaatcacccgccagttttgatcgctctcaaccagttctttcaggctttgcggcggatttttcagtttgttcttgtcatagacgaaggcgaaatagccgtaatcatacggtacgaaagtgtcattattccagccgccaggaacgttaacggcttccgctgccacaccgcttttagcaaacagccctgttttgctggcggcgtctaacagattgttatccagccccagcaccacatcggctttgctgtttttgccttccatccgtagacggttgagcagcgaaacgccatcttccagcgccaccagtttcagttcgcaattacagtctgcttcaaaggcttttttgactaccggaccaggtccccagtcagcggcaaaggaatcgtaggtataaacagttagaacaggtttagcgaaaacaggcgctgtgcacagcaacagcaggggaagacatttttttaacactttgcacctcacaaaagagtggcaaaggacttgagaaggagcctcaaatcccttcgccggcgttatccggatcaggttcgacgggtattttctcagcgcacgcggctgcgtggcaccccgttgagaacggcgttagtgtagtgattttgttatcaaccagcaatcatggatccggtggtgcaaaccacgctgatttaaaatcgaaccagccgagggtgttcatgcgcaggccgcgcatactacgttgcccctgaatgatcagccagtggtggataagtggcaccattgctttgctggcgaccagttgctggcaccagttcgccaggttcatttcgccattgcgccagcgggcggcgtcggcttgccagtcgatcggaatacagtgttggagcagcggcacctcgcacaagtgcgcgaacagcgaaaaatccagcggcagcgtaaagttggcgctgttaagccagatatcgctctcgatctctccttcatgccactgatcgtagctgatctctttgatttccagcgtgacctggtgacttgccagaatctgctgcatgatcccggcaatcacccgatgctcgctgtgatcctgataaaaggtcagggtgaggctttccagaccagccggtttttcgctctttatggtgcgggcatggtgccaacgggggagcagtccataagccgggaaccacagttgctggtactgttcctcagcgaaatagaccagattcgtcggagaaagcacatagcttacccagtctctgacttgctgattcgcccctcgatgggtgcggctgtcgaacagtaaatagtagcaaccttcctccaggcggctttcaatctctttttcctcgccctgtggaccttttagcatcagccctccggctggctcgtcggcaatttccggcagaacccagacgttaacttcgtcgattaatgcccggtaaccgaagaagtcatcgaatgcctgaattttcagttgattggtgctgttgcggatcaccgcatacggaccggtgccgatgggatggctggcaaagttactgagggtttcccattcgcgcggcaggatcattgccggaacttgccccagcagtaacggcaaccagcggtccggttgcgtgagatggatatccagcgtccagggcgtcggcgacacaatgttagcaatatgcgaatagagcggaagcgtattgattcgttttaaagaggcgatcacatcgtccatttccagttcacgaccatggtgaaaatggactcctggacgcaaaaagaaacgccagtgaagcggtgatatttgctgccagtggtgtgcgatgtctgcttccagttccccattttcctcatttatgcgcgttagcgaactgaagatttgccgggcgatatgggtttcagaacggcgcaatgcgctgccaggtagcagattacgcaacggacgatagtagagcacgcgcaggatgtgccgcccctggcggaagctgcggcccagatgagaaaccagcatttgccgcacagtcgctttgtcgccaaccaactgcactagttggtcgatacgatcctgctccagcaggtcttccgcccgctgttgctgaagcgccagcccggtatagaggaatgtcaggcgtgaacgtttaccgcgcccgacttccgcttcccacgtcagccagccgcgatcctgcatggtgttgagcagggtgcgcatatgacgacgcgagcaactcagtaacgctgccagttcgttgagcgtggtctcctgagatttaccctcgcagcattgccacaggcggatgaactgttgttgcagacgagcagatggcataaaaggggaactcctgcgcaaaagacagcaattttattttccctatattaagtcaataattcctaacgatgaagcaaggaggtgccccatgcgtcagttttatcagcactattttaccgcgacagcgaagttgtgctggttgcgttggttaagcgtcccacaacgattaaccatgcttgaagagctgatgcagtgggaggggagtcattctgactactgatttgcggacatcatgtgtgactgagtattggtgttaatcgccacgccagcagtgattatctgctggcttttttctttttggcgattgagtgccggacggtgtacaaactaacgcataaacgccggttgcttctcttcataagacgcaatagcatcgtcgtgctgcagagtcaggccgatgctgtccagaccgttcatcatgcagtggcggcggaaggcatcgatggtaaagcgataagttttctctcccgctttcacctcttgcgcttccaggtctacatcaaaatgaatccccggattggctttcaccagcgcaaacagctcatccacttctgcatcgcttaatttcaccggcagcagctggttgttaaagctattgccgtagaagatgtcagcaaaactcggcgcaatcaccaccttaaaaccgtaatcggtcaatgcccacggcgcgtgctcacgcgaggaaccgcagccgaagttttctcgtgccagcaaaatggaagcgccctgatactgcgggaagttcagcacgaagtccgggtttggctgttggcctttttcatccagaaaacgccagtcgttaaacagatgcgcgccaaaacccgtacgggtcactttctgcaaaaactgtttcgggatgattgcatcggtatcgacattggcggcatccaacggaaccaccaggcctgtgtgtttgataaatttctctgccatggtgtgctccttatttaatgttgcgaatgtcggcgaaatgtccggtcacagccgcggcggcagccattgccggactgaccagatgcgtgcgcccgccgcgcccctggcggccttcaaagttacggttgctggtggaggcgcaacgttcgcccggattcaggcggtcgttgttcatcgccaggcacattgaacaacctggcaagcgccattcaaaaccagcttcgataaaaattttgtccagaccttccgcttccgcctgggctttaaccggaccggagccgggaaccaccagcgcttgtacgcctggcgcgactttccggcctttggcgatttccgctgccgcgcgtaaatcttcaatacgcgagttagtacaggaaccaataaacactttgtcgatagccacttctgtcagcggaatacccggtttcagccccatataggccagcgctttttctgccgacgcgcgttcaaccggatcggcaaacgaagccggatcgggaatattgtcgttcacagaaatcacctggcctggattggtgccccaggtgacctgcggcgaaatctcttctgcttgcagagtgacaacggtatcgaaagttgctccttcgtcggtttgcagggttttccagtaggcaacggcgtcgtcgaaatctttgcctttcggcgcatgcagacggcctttaacatagttaaaggtggtttcgtccggtgcaaccagaccggcttttgcgcccatttcgattgccatattgcacagggtcatacgaccttccatgcttaaatcacggattgcttcgccgcaaaattccaccacatgcccggtaccgcctgcgctgccggttttaccaataattgccagcacgatatcttttgcggtaatgcccggcgcggctttgccctggacttcaattttcatggtcttcgcccggccctgtttcagggtttgcgttgccagtacgtgttcaacttcggaagtgccgataccaaaggccagtgcgccaaacgcgccgtgggtggcggtatgtgagtcgccgcagacaatggtcatccccggcaaggtcacgccctgttccggccccattacgtggacgatcccctgatacgggtgattcaggtcatacagctcgacgccaaattctttgcagtttttgatcagctcctgcatctggatgcgcgccatttcaccgcaggcattaatgtctttcgtctgagtagagacgttgtgatccatggtggcgaaggttttgcccggctgacgtaccgggcgaccgtgggcgcgcagaccatcgaacgcctgcggtgaggtcacttcatgcaccaggtggcggtcgatatataacagcggggtttcgttttcggcttcgtacactacgtgagcgtcgaataatttttcgtataacgtcttagccatgattacaccccttctgccacatagcgggcaatgatatcgcccatttcatcggtactaacggcggcagcgccacgggctaaatccccagtgcgaatgccttcttctaatgcgcggttaatggcgcgttcaatggcggaagccgcatcatcggcatccaggctgtaacgcagcagcagcgccagcgacagaatttgtgcaatcgggttggcgatatttttacctgcgatatcgggtgccgagccgcccgccggttcatacagaccaaaaccttgctcgttcaggctggcggaaggcaacatccccattgagccagtgatcattgcgcactcatcagacagaatgtcgccaaacaggttggagcacagcaagacgtcaaactgtgatggatctttaatcagctgcatggtggcgttgtcgatgtacatatgcgccagttcgacatccgggtattccgtggcgatctcgttaacgatctcccgccataaaatagaggattgcagcacgttggctttgtcgattgaggtgactttgtggcgacgcttgcgggcagattcaaatgcgatgcgggcaatacgctcgatctcaaaacggtggtacacctcggtatcaaacgctttttcatattgtccgctaccttcgcggccttttggctgaccgaaatagatgccgccggtcagttcgcgcacacacaggatgtcaaagccgtttgcggcaatgtcagcacgcagtgggcagaacgcttccagcccctgatacagttttgccggacgcagattgctgaataatttgaagtgtttacgcaaaggcagcagtgcgccgcgttctggttgctggtctggcggcaaatgttcccacttcggaccacctaccgagccaaacagcacggcatcggcttgctcacaaccttcaaccgtcgcaggcggcagcggctgtccgtggttatcaatggctgcgccgcctacatcgtaatggctggtggtgatacgcatcgcaaatcggttgcgcacggcatccagcactttcagcgcctgggtcatcacttccggaccaataccgtcccccggcaatacggcaatatggtaattcttcgacatcacacggtttccttgttgttttcgttgtgttgagctttgcgttgcaactctttttcgacttctgcggcacgccagatattgttcagtacgtgcaccatggctttggcggaggactcgacaatatcggtggccaggccgacgccgtggaagcggcgaccgttgtagttggcgacaatatccacctgacccagcgcatctttaccgtggcctttggcggtcaggctgtatttcaccagttcgacgttatagtcagtgatgcggtttatcgcctggtagacggcatcgaccggaccgttaccgttggcggcttctgctttgacttcttcgccacaggccagtttgacggcggcagtggcaatatcgttagaacctgactgcacgctgaagtaatccagacggaaatgctccggctcttcttgctgcttaccgatgaaggccagcgcctccagatcgtaatcaaacacctggccttttttgtccgccagcttcaggaaagcgtcgtacaggttgtctaaattatattcactttctttatatcccatctcatccatgcgatgtttcaccgccgcacgccccgaacgagaggtcagattcagctggatttggttcagaccaatagattctggtgtcatgatttcgtagttttcgcggtttttcagtacaccatcctggtggataccggaggagtgtgcgaatgcgccgctgccaacaatggctttgtttgccgggatcggcatattacaaatctggctaactaactggctggtgcgccatatctcctggtgattgatggcggtgtggacgttgagaatatccttacgaactttgatcgccatgatgacttcttcaagggaacagttaccggcacgctcgccgatcccgttcattgcgccttctacctgccgtgctccggcatgtaccgccgccagtgagttgccgaccgccaggcccaaatcgtcgtgggtatgtacggaaataatggctttgtcgatgttgggtacgcgttcatacaggccgctgatgattccggcgaactcaaatggcatggtgtagcccacggtgtctggaatgttgatggtggtggcaccggcattaatcgccgcttcgaccactcgcgccagatcggcaattggggtgcgtccggcatcttcgcaagaaaattcaacatcatcggtgtaattacgggcgcgtttcaccatatagatagcgcgttcgatcacttcgtccagcgtgctgcgcagcttggtggcgatgtgcattggcgaagtggcaataaaggtatgaatacggaaggcttcggcgactttcagggattcggctgccacgtcaatatctttttccacgcagcgagctaacgcgcatacacggctgtttttaacctggagagcgatggtctgcactgattcaaaatcacccggcgaagagacggggaaaccgacttccataacgtcaacacccatacgctcaagggccagcgcaatttgcagtttttctttcacactcaagcttgcctgtaacgcctgttcaccgtcgcgcaatgtggtatcgaaaataatgacttgctggctcatggtttgggtccttgtctctttttgagcgcctcgcttcgggcataaaaaaacccgcgcaatggcgcgggttttttgtttgactgagtgctgacttaattctgaatgccgctcaccagtctaccgcgcaaagaagatgcgtttagtagtagtggaccgataaagcgaacgatgtgagtcattaaatcagctccagatgaatgcgatatgcttttagagttactggataccaaaacggatgtcaaccctgatgcaacaaaaacgtccagccagcgtgagttctgcatccgtcaaattagctaattgtgctgcggtggttaaaacaagcgatattaatttctgcttaaccaccgccgcttttcatcggttgacatatttcagaataaatttttgcatctaatcgacgagggaaagggggataaaatgcacgcgttacaaaacctatcctgatgatttgtattgaattatatgtattgcgaattttttgatattcatttggtgaatattattgatcaattaatgttaagaattaaaacattaaacatataaattaattattaaaaagcacatttaatccattttgtggatgattgagtattcgtggtagttatgattagattgttttcgcaacaaaaacattatggattattatgctgtggtaaatgactctttgctcggcagtggattctgtttttatcagaacccgtatctttatgttttcctaattttactcattttcctttttcttattttatatgcatgataaatcatattctcgaggattatttctctgcattccaataagggaaagggagttaagtgtgacagtggagttaagtatgccagaggtacaaatagatcatccagagacggcggagttaagcaagccacagctacgcatggtcgatctcaacttattaaccgttttcgatgccgtgatgcaggagcaaaacatcacccgtgccgctcatgctctgggaatgtcgcaacctgcggtcagtaacgctgttgcacgcctgaaggtgatgtttaatgacgagctttttgttcgttatggccgtggtattcaaccgactgctcgcgcatttcaactttttggttcagttcgtcaggcattgcaattagtacaaaatgaattgcctggttcaggttttgaacccgcgagcagtgaacgtgtatttcatctttgtgtttgcagcccgttagacagcattctgacctcgcagatttataatcacattgagcagattgcgccaaatatacatgttatgttcaagtcttcattaaatcagaacactgaacatcagctgcgttatcaggaaacggagtttgtgattagttatgaagacttccatcgtcctgaatttaccagtgtgccattatttaaagatgaaatggtgttggtagccagcaaaaatcatccaacaattaaaggcccgttactgaagcatgggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggactgttgtggcgcacgtcttcggtgaacgcactctggccacactggagcgtcttctgagcctgctgtcggcctttgaggtcgtggtatggatgacggatggctggccgctgtatgaatcacgcctgaagggaaagttgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattacctgaagcatgatgtttataacgaacaacatgctgcggtttcgctcgatcgtttcgcatcatttagtcaaacctggtatgacacggtagataagcaagccagtatcgcgtatcagggcatggcaatgatgagcgtacttagcgtggtgtcgcaaacgcatctggtcgctattgcgccgcgttggttggctgaagagttcgctgaatccttagagttacaggtattaccgctgccgttaaaacaaaacagcagaacctgttatctctcctggcatgaagctgccgggcgcgataaaggccatcagtggatggaagagcaattagtctcaatttgcaaacgctaactgaatgcagaataggtcagacatcaatgtctggtttattctgcattttttattgaatgtagaattttattctgaatgtttgtgctctctattttaggattaattaaaaaaatagagaaattgctgtaagttgtaggattcagccgatttattatcaatttcatcctctgtaatggaggattttatcgtttcttttcacctttcctcctgtttattcttattaccccgtgtttatgtctctgtctgccaattgcttaagcaagatcggacggttaatgtgttttacacattttttccgtcaaacagtgaggcaggccatggagatgttgtctggagccgagatggtcgtccgatcgcttatcgatcagggcgttaaacaagtattcggttatcctggaggcgcggtccttgatatttacgatgcattgcataccgtgggtggtatcgatcatgttttagttcgccatgagcaggcggcggtgcatatggccgatggtctggcgcgcgcgaccggggaagtcggcgtcgtgctggtaacgtcgggtccaggggcgaccaatgcaattactggcattgccaccgcttatatggattccattccattagttgtcctttccgggcaggtagcgacctcgttgataggttatgatgcctttcaggagtgcgacatggtggggatttctcgcccggtggttaaacacagttttctggttaagcaaacggaagacattccgcaggtgctgaaaaaggctttctggctagcggcaagtggtcgtcctggacccgtggtcgttgatttaccgaaagatatcctaaatccggcgaacaaattaccctatgtctggccggagtcggtcagtatgcgttcttacaatcccacgacctccgggcataaagggcaaattaagcgcgctctgcaaacgctggtggcggcaaaaaaaccggttgtctacgtaggcggtggggcaatcacggcgggctgccatctgcagttgaaagaagcggtggaggtgttgaatctgcccgttgtttcctctttgatggggctgggggcgtttccggcaacgcatcgccaggcactgggcatgttgggaatgcacggtacctacgaagccaatatgacgatgcataacgcggatgtgattttcgccgtcggggtacgttttgatgaccgaacgacgaacaatctggcaaagtattgcccaaatgccactgttctgcatatcgatattgatccaacctcaatttctaaaaccgtgactgctgatatcccgattgtgggggatgctcgccaggtcctcgaacaaatgcttgaactcctgtcgcaagaatccgcccatcaaccgctggatgagatccgcgactggtggcagcagattgaacagtggcgcgctcgtcagtgcctgaaatatgacactcacagtgaaaagattaaaccgcaggcggtgatcgagactctttggcggttgactaatggggacgcttacgtgacgtccgatgtcgggcagcaccagatgtttgctgcgctttattatccattcgacaaaccgcgtcgctggatcaactctggcggcctcggcacgatgggttttggtttacctgcggcactgggcgtcaaaatggcgttgccagaagaaaccgtggtttgcgtcactggtgacggcagtattcagatgaacatccaggaactgtctaccgcgttgcaatatgagttgcccgtactggtggtgaatctcaataaccgctatctggggatggtgaagcagtggcaggacatgatctattccggccgtcattcacaatcttatatgcagtccttaccagacttcgtccgtctggcggaagcctatggtcacgtcgggatccagatctctcatccgcaagaactggaaagcaaacttagcgaggcgctggaacaggtgcgcaataatcgcctggtgtttgttgatgttaccgtcgatggcagtgagcacgtctacccgatgcagattcgcgggggcggaatggatgaaatgtggttaagcaaaacggagagaacctgattatgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtgcttgagcaaatcgaaaagcaattacacaagctggtcgatgtcttgcgcgtgagcgagttggggcagggcgcgcacgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcgataagcttgatgcatttttagcatcgattcgcgatgtggcgaaaattgtggaagttgctcgctctggtgtggtcggactttcacgcggcgataaaataatgcgttgagaatgatctcaatgcgcaatttgcagcccaacatgtcacgttgggctttttttgcgaaatcagtgggagcctggaataaaagcagttgccgcagttaattttctgcgcttagatgttaatgaatttaacccataccagtacaatggctatggtttttacattttacgcaaggggcaattgtgaaactggatgaaatcgctcggctggcgggagtgtcgcggaccactgcaagctatgttattaacggcaaagcgaagcaataccgtgtgagcgacaaaaccgttgaaaaagtcatggctgtggtgcgtgagcacaattaccacccgaacgccgtggcagctgggcttcgtgctggacgcacacgttctattggtcttgtgatccccgatctggagaacaccagctatacccgcatcgctaactatcttgaacgccaggcgcggcaacggggttatcaactgctgattgcctgctcggaagatcagcccgacaacgaaatgcgctgcattgagcaccttttacagcgtcaggttgatgccattattgtttcgacgtcgttgccacctgagcatcctttttatcaacgctgggctaacgacccgttcccgattgtcgcgctggaccgcgccctcgatcgtgaacacttcaccagcgtggttggtgccgatcaggatgatgccgaaatgctggcggaagagttacgtaagtttcccgccgagacggtgctttatcttggcgcgctgccggagctttctgtcagcttcctgcgtgaacaaggcttccgtactgcctggaaagatgatccgcgcgaagtgcatttcctttatgccaacagctatgagcgggaggcagctgcccagttattcgaaaaatggctggaaacgcatccgatgccgcaggcgctgttcacaacgtcgtttgcgttgttgcaaggggtgatggatgtcacgctacgtcgcgacggcaaactgccttctgacctggcaattgccacctttggcgataacgaactgctcgacttcttacagtgcccggtgctggcagtggctcaacgtcaccgcgatgtcgcagaacgtgtgctggagattgtcctggcgagcctggacgaaccgcgtaagccaaaacctggtttaacgcgcattaaacgtaatctctatcgccgcggcgtgctcagccgtagctaagccgcgaacaaaagtacgcgccaggtgaatttctctctggcgcgttgagtacgggaatggacatcaatatccttaaagtaaataagactattcctggctattattgataaatgcttttaaacccgcccgttaattaactcacctgctgaaattcacaataattaaatgatattgacagcgcgtttttgcattattttgttacatgcagagatgaattgccgatttaacaaacacttttctttgtttttgcgcaaacctgctggcatcaagcgccacacagacgcaacagggactgttaaccagagaagatatgtcctaaaatgccgctcgcgtcgcaaactgacactttatatttgctgtggaaaatagtgagtcattttaaaacggtgatgacgatgagggattttttcttacagctattcataacgttaatttgcttcgcacgttggacgtaaaataaacaacgctgatattagccgtaaacatcgggttttttacctcggtatgccttgtgactggcttgacaagcttttcctccgctccgtaaactcctttcagtgggaaattgtggggcaaagtgggaataaggggtgaggctggcatgttccggggagcaacgttagtcaatctcgacagcaaagggcgcttatcagtgcctacccgttatcgggaacagctgcttgagaacgctgccggtcaaatggtttgcaccattgacattcatcacccgtgcctgctgctttaccccctgcctgaatgggaaattatcgagcaaaaattatcgcgtctgtcgagcatgaacccggttgagcgccgtgtgcagcgcctactgttaggtcatgccagcgaatgtcagatggatggcgcaggtcgattgttaatcgcgccagtactgcggcaacatgccgggctgacaaaagaagtgatgctggttggacagttcaacaagtttgagctgtgggatgaaacaacctggcatcaacaggtcaaggaagatatcgacgcagagcagttggctaccggagacttatcggagcgactgcaggacttgtctctataaaatgatggaaaactataaacatactacggtgctgctggatgaagccgttaatggcctcaatatccgtcctgatggcacctacattgatgggacttttggtcgcggtggtcactcacgtctgatcctctcgcagcttggcgaagaggggcgtttgctggcgatcgatcgcgacccgcaggctatcgccgttgcgaagactattgatgatccgcgcttctccatcatccacggacctttctccgcgctgggcgaatacgttgccgagcgcgatcttatcggcaagatcgacggcattctcctcgatcttggcgtctcttcaccgcaacttgatgatgctgagcgcggcttttcctttatgcgcgatggtccgctggacatgcgtatggacccaacccgtgggcagtcagccgctgaatggctacaaaccgcagaagaagccgatatcgcctgggtattgaaaacctatggtgaagagcgttttgccaaacgcattgcccgcgccattgtcgagcgtaaccgcgaacagccgatgacccgcaccaaagaactggcggaagtcgtggctgccgcaacgccggtgaaagataagtttaaacatcccgcgacccgtaccttccaggcggtgcgcatttgggtaaacagtgaactggaggagatagagcaggcgctaaaaagctcgctcaatgtgctggccccgggtgggcggctttcgatcatcagcttccactcacttgaagaccgcattgtgaaacgttttatgcgtgaaaacagccgcggtccgcaagttccggcagggttaccgatgacagaagagcagctcaaaaaactggggggccgtcagttgcgagcactaggtaagttgatgccgggcgaagaagaggtggctgagaaccctcgtgcccgtagttcagttctgcgtattgcagagaggacgaacgcatgatcagcagagtgacagaagctctaagcaaagttaaaggatcgatgggaagccacgagcgccatgcattgcctggtgttatcggtgacgatcttttgcgatttgggaagctgccactctgcctgttcatttgcattattttgacggcggtgaccgtggtaaccacggcgcaccatacccgtttactgaccgctcagcgcgaacaactggtgctggagcgagatgctttagacattgaatggcgcaacctgatccttgaagagaatgcgctcggcgaccatagccgggtggaaaggatagccacggaaaagctgcaaatgcagcatgttgatccgtcacaagaaaatatcgtagtgcaaaaataaggataaacgcgacgcatgaaagcagcggcgaaaacgcagaaaccaaaacgtcaggaagaacatgccaactttatcagttggcgttttgcgttgttatgcggctgtattctcctggcgctggcttttctgctcggacgcgtagcgtggttacaagttatctccccggatatgctggtgaaagagggcgacatgcgttctcttcgcgttcagcaagtttccacctcccgcggcatgattactgaccgttctggtcgcccgttagcggtgagcgtgccggttaaagcgatttgggctgacccgaaagaagtgcatgacgctggcggtatcagcgtcggtgaacgctggaaggcgctggctaacgcgctcaatattccgctggatcagctctcagcccgcattaacgccaacccgaaagggcgctttatttatctggcgcgtcaggtaaaccctgacatggcggactacatcaaaaaactgaaactgccggggattcatctgcgtgaagaatctcgccgttattatccatccggcgaagtgactgctcacctcatcggttttactaacgtcgatagccaagggattgagggtgtcgagaagagtttcgataaatggcttaccgggcagccgggtgagcgcattgtgcgtaaagaccgctatggtcgcgtaattgaagatatttcttctactgacagccaggcagcgcacaacctgacgctgagtattgatgaacgcctgcaggcgctggtttatcgcgaactgaacaacgcagtggcctttaacaaggctgaatctggtagcgccgtgctggtggatgtcaacaccggtgaagtgctggcgatggctaacagcccgtcatacaacccaaataatctgagcggcacgccgaaagaagcgatgcgtaaccgtaccatcaccgacgtgtttgaaccgggctcaacggttaaaccgatggtggtgatgaccgcgttgcaacgtggcgtggtgcgggaaaactcggtactcaataccgttccttatcgaattaacggccacgaaatcaaagacgtggcgcgctacagcgaattaaccctgaccggggtattacagaagtcgagtaacgtcggtgtttccaaactggcgttagcgatgccgtcctcagcgttagtagatacttactcacgttttggactgggaaaagcgaccaatttggggttggtcggagaacgcagtggcttatatcctcaaaaacaacggtggtctgacatagagagggccaccttctctttcggctacgggctaatggtaacaccgttacagttagcgcgagtctacgcaactatcggcagctacggcatttatcgcccactgtcgattaccaaagttgaccccccggttcccggtgaacgtgtcttcccggaatccattgttcgcaccgtggtgcatatgatggaaagcgtggcgctaccgggcggcggcggcgtgaaggcggcgattaaaggctatcgtatcgccattaaaaccggtaccgcgaaaaaggtcgggccggacggtcgctacatcaataaatatattgcttataccgcaggcgttgcgcctgcgagtcagccgcgcttcgcgctggttgttgttatcaacgatccgcaggcgggtaaatactacggcggcgccgtttccgcgccggtctttggtgccatcatgggcggcgtattgcgtaccatgaacatcgagccggatgcgctgacaacgggcgataaaaatgaatttgtgattaatcaaggcgagggtacaggtggcagatcgtaatttgcgcgaccttcttgctccgtgggtgccagacgcaccttcgcgagcactgcgagagatgacactcgacagccgtgtggctgcggcgggcgatctctttgtagctgtagtaggtcatcaggcggacgggcgtcgatatatcccgcaggcgatagcgcaaggtgtggctgccattattgcagaggcgaaagatgaggcgaccgacggtgaaatccgtgaaatgcacggcgtaccggtcatctatctcagccagctcaacgagcctttatctgcactggcgggccgcttttaccatgaaccctctgacaatttacgtctcgtgggcgtaacgggcaccaacggcaaaaccacgactacccagctgttggcgcagtggagccaactgcttggcgaaaccagcgcggtaatgggcaccgttggtaacggcctgctggggaaagtgatcccgacagaaaatacaaccggttcggcagtcgatgttcagcatgagctggcggggctggtggatcagggcgcgactttttgcgcaatggaagtttcatcccacgggctggtacaacaccgtgtggcggcattgaaatttgcggcgtcggtctttaccaacttaagccgagatcaccttgattatcatggtgatatggaacactacgaagccgcgaaatggctgctttattctgcacatcattgcggtcaggcgattattaacgccgacgatgaagtgggccgccgctggctggcaaaactgccggacgcggttgcggtatcaatggaagatcatatcaatccgaactgtcacggacgctggttgaaagcgaccgacgtgaactatcacgacagcggtgcgaccattcgctttagctcgagttggggcgatggggaaattgaaagtcgcctgatgggcgcattcaacgtcagcaacctgctgctggcgctggcgacactgctggcactcggctatccgctggctgatttgctgaaaaccgccgcgcgtctgcaaccggtttgcggacgtatggaagtgttcactgcaccaggcaaaccgacggtggtggtggattacgcgcatacgccggatgcactggaaaaagccttacaggcggcgcgcctgcactgtgcgggcaagctgtggtgcgtctttggctgcggtggcgatcgtgataaaggcaaacgtccactgatgggcgcaatagctgaagagtttgctgacgtggcggtggtgacggacgataacccgcgtaccgaagagcctcgtgccatcatcaacgatattctggcgggaatgttagatgccggatatgccaaagtgatggaaggccgtgctgaagcggtgacttgcgccgttatgcaggctaaagagaatgatgtggtactggtcgcgggcaaaggccatgaggattaccagattgttggcaatcagcgtctggactactccgatcgcgtcacggtggcgcgtctgctgggggtgattgcatgattagcgtaacccttagccaacttaccgatattctcaacggtgaactgcaaggtgcagatattacccttgatgctgtaaccactgacacgcgaaaactgacgccgggctgcctgtttgttgccctgaaaggcgaacgtttcgatgctcatgattttaccgaccaggcgaaagctggcggcgcaggcgcactactggttagccgtccgctggatattgatctgccgcagttaatcgtcaaggatacgcgtctggcgtttggtgaactggctgcatgggttcgccagcaagttccggcgcgcgtggttgctctgacaggttcctccggcaaaacctccgttaaagagatgacggcggcaattttaagccagtgcggcaacacactttatacggcaggcaatctcaataacgacatcggtgtaccgatgacgctgttgcgcttaacgccggaatacgattacgcagttattgaacttggcgcgaaccatcagggtgaaattgcctggactgtgagtctgactcgcccggaagcggcgctggtcaacaacctggcagcggcgcatctggaaggttttggctcgcttgcgggtgtcgcgaaagcgaaaggtgaaatctttagcggcctgccggaaaacggtatcgccattatgaacgccgacaacaacgactggttgaactggcagagcgtaattggctcacgcaaagtgtggcgtttctcacctaatgccgccaacagcgatttcaccgccaccaatatccatgtaacctcgcacggtacggaatttaccctgcaaaccccaacaggtagcgtcgatgttctgctgccgttgccggggcgtcacaatattgcgaatgcgctggcagccgctgcgctctccatgtccgtgggcgcaacgcttgatgctatcaaagcggggctggcaaatctgaaagctgttccaggccgtctgttccccataaaactggcagaaaaccagttgctgctcgacgactcctacaacgccaatgtcggttcaatgaccgccgctgttcaggttctggctgaaatgccgggctaccgcgtgctggtggtgggcgatatggcggaactgggcgctgaaagcgaagcctgccatgtacaggtgggcgaagcggcaaaagctgctggtattgactgcgtgttaagtgtgggtaaacaaagccatgctatcagcaccgccagcggcgttggcgaacatttttccgataaaactgcgcttatcgcgcgtcttaaatcactgattgctgagcaacaggtaattacgattttagttaagggttcacgtagtgctgccatggaagaggtagtacgcgctttacaggagaatgggacatgttagtttggctggccgaacatttggtcaaatattattccggctttaacgtcttttcctatctgacgtttcgcgccatcgtcagcctgctgaccgcgctgttcatctcattgtggatgggcccgcgtatgattgctcatttgcaaaaactttcctttggtcaggtggtgcgtaacgacggtcctgaatcacatttcagcaagcgcggtacaccgaccatgggcgggataatgatcctgacggcgattgtgatctccgtgctgctgtgggcttacccgtccaatccgtacgtctggtgcgtactggtggtgctggtaggttacggtgttattggctttgttgatgattatcgcaaagtggtgcgtaaagacaccaagggcctgattgcccgttggaagtatttctggatgtcggtgattgcgctgggtgtcgccttcgcgctgtaccttgtcggcaaagacacgcccgcaacgcagctggtggttccgttctttaaagatgtgatgccgcaactggggctgttctacattctgctggcttactttgtcattgtgggtactggcaacgcggtaaacctgaccgatggtctcgacggtttggcaattatgccgaccgtatttgtcgccggtggttttgcgctggtggcgtgggcgaccggcaacatgaactttgccagctatttacacataccgtatctacgacacgccggggaactggtcattgtctgtaccgcgatagtcggggcagggctgggcttcctgtggtttaacacctatccggcgcaggtctttatgggcgatgtaggttcgctggcgttaggtggtgcgttaggtattatcgccgtactgctgcgtcaggaattcctgctggtgattatggggggcgtgttcgtggtagaaacgctttccgtcatcctgcaggtcggctcctttaaactgcgcggacaacgtattttccgcatggcgccgattcatcaccactatgaactgaaaggctggccggaaccgcgcgtcattgtgcgtttctggattatttcgctgatgctggtcctgattggtctggcaacgctgaaggtacgttaatcatggctgattaccagggtaaaaatgtcgtcattatcggcctgggcctcaccgggctttcctgcgtggactttttcctcgctcgcggtgtgacgccgcgcgttatggatacgcgtatgacaccgcctggcctggataaattacccgaagccgtagaacgccacacgggcggtctgaatgatgaatggctgatggcggcagatctgattgtcgccagtcccggtattgcactggcgcatccatccttaagcgctgccgctgatgccggaatcgaaatcgttggcgatatcgagctgttctgtcgtgaagcacaagcaccgattgtggcgatcaccggttctaacggcaaaagcacggtcaccacgctagtgggtgaaatggcgaaagcggcgggggttaacgttggtgtgggtggcaatattggcctgcctgcgttgatgctgctggatgatgagtgcgaactgtacgtgctggaactgtcgagcttccagctggaaaccacttccagcttacaagcggtggcagcgaccattctgaacgtgactgaagatcatatggatcgctatccgtttggtttacaacagtatcgtgcagcaaaactgcgcatttacgaaaacgcaaaagtttgcgtggttaatgctgatgatgccttaacaatgccgattcgcggtgcggatgaacgctgcgtcagctttggcgtcaacatgggcgactatcacctgaatcatcagcagggtgaaacctggctgcgggtgaaaggcgagaaagtgctgaacgtgaaagaaatgaaactttccgggcagcataactacaccaatgcgctggcggcgctggcgctggcagatgccgcagggttaccgcgtgccagcagcctgaaagcgttaaccacattcactggtctgccgcatcgctttgaagttgtgctggagcataacggtgtgcgctgggttaacgattcaaaagcgaccaacgtcggcagtacggaagcggcgctgaatggcctgcacgtagacggcacgctgcatttgttgctggggggcgatggtaaatcggcggactttagcccactggcgcgttacctgaatggcgataacgtacgtctgtattgtttcggtcgggacggcgcgcagctggcggcgctacgcccggaagtggcagaacaaaccgaaactatggaacaggcgatgcgcttgcttgctacgcgtgttcagccgggcgatatggttctgctctccccggcctgtgccagccttgatcaattcaagaactttgaacaacgaggcaatgagtttgcccgtctggcgaaggagttaggttgatgcgtttatctctccctcgcctgaaaatgccgcgcctgccaggattcagtattctggtctggatctccacggcgctaaagggctgggtgatgggctcgcgggaaaaagataccgacagcctgatcatgtacgatcgcaccttactgtggctgaccttcggcctcgcggcgattggctttatcatggtgacctcggcgtcaatgcccataggacaacgcttaaccaacgatccgttcttcttcgcgaagcgtgatggcgtctatctgatcctggcattcattctggcgatcattacgctgcgtctgccgatggagttctggcaacgctacagtgccacgatgctgctcggatctatcatcctgctgatgatcgttctggtagtgggtagctcggttaaaggggcatcgcgttggatcgatctcggtttgctgcgtattcagcctgcggagctgacaaaactgtcgctgttttgctatatcgccaactatctggtgcgtaaaggcgacgaagtacgtaataacctgcgcggcttcctgaaaccgatgggcgtaattctggtgttggcagtgttactgctggcacagccagaccttggtacggtggtggtgttgtttgtgactacgctggcgatgttgttcctggcgggagcgaaattgtggcagttcattgccattatcggtatgggcatttcagcggttgtgttgctgatcctcgccgaaccgtaccgtatccgccgtgttaccgcattctggaacccgtgggaagatccctttggcagcggctatcagttaacgcaatcgttgatggcgtttggtcgcggtgaactgtggggacaaggtttaggtaactcggtacaaaaactggagtatctgccggaagcgcacactgactttattttcgccattatcggcgaagaactggggtatgtcggtgtggtgctggcacttttaatggtattcttcgtcgcttttcgcgcgatgtcgattggccgcaaagcattagaaattgaccaccgtttttccggttttctcgcctgttctattggtatctggtttagtttccaggcgctggttaacgtaggcgcggcggcggggatgttaccgaccaaaggtctgacattgccgctgatcagttacggtggttcgagcttactgattatgtcgacagccatcatgatgctgttgcgtattgattatgaaacgcgtctggagaaagcgcaggcgtttgtacgaggttcacgatgagtggtcaagggaagcgattaatggtgatggcaggcggaaccggtggacatgtattcccggggctggcggttgcgcaccatctaatggctcagggttggcaagttcgctggctggggactgccgaccgtatggaagcggacttagtgccaaaacatggcatcgaaattgatttcattcgtatctctggtctgcgtggaaaaggtataaaagcactgatagctgcgccgctgcgtatcttcaacgcctggcgtcaggcgcgggcgattatgaaagcgtacaaacctgacgtggtgctcggtatgggcggctatgtatcaggtccaggtggtctggccgcgtggtcgttaggcattccggttgtacttcatgaacaaaacggtattgcgggcttaaccaataaatggctggcgaagattgctaccaaagtgatgcaggcgtttccaggtgctttccctaatgcggaagtggtgggtaacccggtgcgtaccgatgtgctggcgctgccgttgccgcagcaacgtttggctggacgtgaaggtccggttcgtgtgttggtagtgggtggttcccagggtgcacgcattcttaaccagacaatgccgcaggttgctgcgaaactgggtgattcagtcactatctggcatcagagcggcaaaggttcgcaacaatccgttgaacaggcgtatgccgaagcgggacaaccgcagcataaagtgacggaatttattgatgatatggcggcggcgtatgcgtgggcggatgtcgtcgtttgccgctccggtgcgttaacggtgagtgaaatcgccgcggcaggactaccggcgttgtttgtgccgtttcaacataaagaccgtcagcaatactggaatgcgctaccgctggaaaaagcgggcgcagccaaaattatcgagcagtcacagcttagcgtggatgctgtcgccaacaccctggccgggtggtcgcgagaaaccttattaaccatggcagaacgcgcccgcgctgcatccattccggatgccaccgagcgagtggcaaatgaagtgagccgggctgcccgggcgtaattgtagcgatgccttttgcatcgtatgaatttaagaagttaatggcgtaaagaatgaatacacaacaattggcaaaactgcgttccatcgtgcccgaaatgcgtcgcgttcggcacatacattttgtcggcatcggtggtgccggtatgggcggtattgccgaagttctggccaatgaaggttatcagatcagtggttccgatttagcgccaaatccggtcacgcagcagttaatgaatctgggagcgacgatttatttcaaccatcgcccggaaaacgtacgtgatgccagcgtggtcgttgtttccagcgcgatttctgccgataacccggaaattgttgcagctcatgaagcgcgtattccggtgatccgtcgtgctgaaatgctggctgagttaatgcgttttcgtcatggcatcgccattgccggaacacacggcaaaacgacaaccaccgcgatggtttccagcatctacgcagaagcggggctcgacccaaccttcgttaacggcgggctggtaaaagcggcgggggttcatgcgcgtttggggcatggtcggtacctgattgccgaagcagatgagagtgatgcatcgttcctgcatctgcaaccgatggtggcgattgtcaccaatatcgaagccgaccacatggatacctaccagggcgactttgagaatttaaaacagacttttattaattttctgcacaacctgccgttttacggtcgtgcggtgatgtgtgttgatgatccggtgattcgcgaattgttaccgcgtgtgggacgtcagaccacgacttacggcttcagcgaagatgccgacgtgcgtgtagaagattatcagcagattggcccgcaggggcactttacgctgctgcgccaggacaaagagccgatgcgcgtcaccctgaatgcgccaggtcgtcataacgcgctgaacgccgcagctgcggttgcggttgctacggaagagggaattgacgacgaggctattttgcgtgcgctggagagcttccaggggacggggcgccgtttcgatttcctcggtgaattcccgctggagccagtgaatggaaaaagcggtacggcaatgctggtcgatgactacggccaccacccgacggaagtggacgccactattaaagcggcgcgcgcaggctggccggataaaaacctggtaatgctgtttcagccgcaccgttttacccgtacgcgcgatctgtatgatgatttcgccaatgtgctgacgcaggttgataccctgttgatgctggaagtgtatccggctggtgaagcgccaattccgggagcggacagccgttcgctgtgtcgcacaattcgtggacgtgggaaaattgatcccattctggtgccggacccggcgcaggtagccgagatgctggcaccggtattaaccggtaacgacctgattctcgttcagggggctggtaatatcggaaaaattgctcgttctttagctgaaatcaaactgaagccgcaaactccggaggaagaacaacatgactgataaaatcgcggtcctgttgggcgggacctccgctgagcgggaagtttctctgaattctggcgcagcggtgttagccgggctgcgtgaaggcggtattgacgcgtatcctgtcgacccgaaagaagtcgacgtgacgcaactgaagtcgatgggttttcagaaagtttttatcgcgctacacggtcgcggcggtgaagatggtacgctgcagggaatgctcgagctgatgggcttgccttataccggcagcggagtgatggcatctgcgctttcaatggataaactacgcagcaaacttctgtggcagggtgccggtttaccggtcgcgccgtgggtagcgttaacccgcgcagagtttgaaaaaggccttaacgataagcagttagcagaaatttcttctctgggtttgccggttatcgttaagccgagccgcgaaggttccagtgtgggaatgtcaaaagtagtagcagaaaatgctctacaagatgcattaagattggcatttcagcacgatgaagaagtattgattgaaaaatggctaagtgggccggagttcacggttgcgatactcggtgaagaaattttaccgtcaatacgtattcaaccggccggaaccttctatgattatgaggcgaagtatctctctgatgagacacagtatttctgccccgcaggtctggaagcgtcacaagaggccaatttgcaggcattagtgctaaaagcatggacgacgttaggttgcaaaggatggggacgtattgacgttatgctggacagtgatggacagttttatctgctggaagccaatacctcaccgggtatgaccagccacagtctggtgccgatggcggcacgtcaggcaggtatgagcttctcgcagttggtagtacgaattctggaactggcggactaatatgtcgcaggctgctctgaacacgcgaaatagcgaagaagaggtttcttctcgccgcaataatggaacgcgtctggcggggatccttttcctgctgaccgttttaacgacagtgttggtgagcggctgggtcgtgttgggctggatggaagatgcgcaacgcctgccgctctcaaagctggtgttgaccggtgaacgccattacacgcgtaatgacgatatccggcagtcgatcctggcgttgggtgagccaggtacctttatgacccaggatgtcaacatcatccagacgcaaatagaacaacgcctgccgtggattaagcaggtgagcgtcagaaagcagtggcctgatgaattgaagattcatctggttgaatatgtgccgattgcgcggtggaatgatcaacatatggtagacgcggaaggaaacaccttcagcgtgccgccagatcgcaccagcaagcaggtgcttccaatgctgtatggcccggaaggcagcgccaatgaagtgttgcagggctatcgcgaaatggggcagatgctggcaaaggacagatttactctgaaggaagcggcgatgaccgcgcgacgttcctggcagttgacgctgaataacgatattaagctcaatcttggccggggcgatacgatgaaacgtttggctcgctttgtagaactttatccggttttacagcagcaggcgcaaaccgatggcaaacggattagctacgttgatttgcgttatgactctggagcggcagtaggctgggcgcccttgccgccaggggaatctactcagcaacaaaatcaggcacaggcagaacaacaatgatcaaggcgacggacagaaaactggtagtaggactggagattggtaccgcgaaggttgccgctttagtaggggaagttctgcccgacggtatggtcaatatcattggcgtgggcagctgcccgtcgcgtggtatggataaaggcggggtgaacgacctcgaatccgtggtcaagtgcgtacaacgcgccattgaccaggcagaattgatggcagattgtcagatatcttcggtatatctggcgctttcaggtaagcacatcagctgccagaatgaaattggtatggtgcctatttctgaagaagaagtgacgcaagaagatgtggaaaacgtcgtccataccgcgaaatcggtgcgtgtgcgcgatgagcatcgtgtgctgcatgtgatcccgcaagagtatgcgattgactatcaggaagggatcaagaatccggtaggactttcgggcgtgcggatgcaggcaaaagtgcacctgatcacatgtcacaatgatatggcgaaaaacatcgtcaaagcggttgaacgttgtgggctgaaagttgaccaactgatatttgccggtctggcatcaagttattcggtattgacggaagatgaacgtgaattgggtgtctgcgtcgtcgatatcggtggtggtacaatggatatcgccgtttataccggtggggcattgcgccacacgaaggtaattccttatgctggcaatgtcgtgaccagtgatatcgcttacgcctttggcacaccgccaagcgacgccgaagcgattaaagttcgccacggttgtgcgctgggctccatcgttggaaaagatgagagcgtggaagtgccgagcgtaggcggtcgtccgccgcggagtctacaacgtcagaccctggcagaggtgatcgagccgcgctataccgagctgctcaatctggtcaacgaagagatattgcagttgcaggaaaagcttcgccaacaaggggttaaacatcacctggcggcaggcattgtattaaccggtggcgcagcgcagatcgaaggtcttgcagcctgtgctcagcgcgtgtttcatacgcaagtgcgtatcggcgcgccgctgaacattaccggtttaacggattatgctcaggagccgtattattcgacggcggtgggattgcttcactatgggaaagagtcacatcttaacggtgaagctgaagtagaaaaacgtgttacagcatcagttggctcgtggatcaagcgactcaatagttggctgcgaaaagagttttaatttttatgaggccgacgatgattacggcctcaggcgacaggcacaaatcggagagaaactatgtttgaaccaatggaacttaccaatgacgcggtgattaaagtcatcggcgtcggcggcggcggcggtaatgctgttgaacacatggtgcgtgagcgcattgaaggtgttgaattcttcgcggtaaataccgatgcacaagcgctgcgtaaaacagcggttggacagacgattcaaatcggtagcggtatcaccaaaggactgggcgctggcgctaatccagaagttggccgcaatgcggctgatgaggatcgcgatgcactgcgtgcggcgctggaaggtgcagacatggtctttattgctgcgggtatgggtggtggtaccggtacaggtgcagcaccagtcgtcgctgaagtggcaaaagatttgggtatcctgaccgttgctgtcgtcactaagcctttcaactttgaaggcaagaagcgtatggcattcgcggagcaggggatcactgaactgtccaagcatgtggactctctgatcactatcccgaacgacaaactgctgaaagttctgggccgtggtatctccctgctggatgcgtttggcgcagcgaacgatgtactgaaaggcgctgtgcaaggtatcgccgaactgattactcgtccgggtttgatgaacgtggactttgcagacgtacgcaccgtaatgtctgaaatgggctacgcaatgatgggttctggtgtggcgagcggtgaagatcgtgcggaagaagctgctgaaatggctatctcttctccgctgctggaagatatcgacctgtctggcgcacgcggcgtgctggttaacatcacagcgggcttcgacctgcgtctggatgagttcgaaacggtaggtaacaccatccgtgcatttgcttccgacaacgcgaccgtggttatcggtacttctcttgacccggatatgaatgacgagctgcgcgtaactgttgttgcgacaggtatcggcatggacaaacgtcctgaaatcactctggtgaccaataagcaggttcagcagccagtgatggatcgctaccagcagcacggtatggctccgctgacccaggagcagaagccggttgctaaagtcgtgaatgacaatgcgccgcaaactgcgaaagagccggattatctggatatcccagcattcctgcgtaagcaagctgattaagaattgactggaatttgggtttcgaggctctttgtgctaaactggcccgccgaatgtatagtacacttcggttggataggtaatttggcgagataatacgatgatcaaacaaaggacacttaaacgtatcgttcaggcgacgggtgtcggtttacataccggcaagaaagtcaccctgacgttacgccctgcgccggccaacaccggggtcatctatcgtcgcaccgacttgaatccaccggtagatttcccggccgatgccaaatctgtgcgtgataccatgctctgtacgtgtctggtcaacgagcatgatgtgcggatttcaaccgtagagcacctcaatgctgctctcgcgggcctgggcatcgataacattgttatcgaagttaacgcgccggaaatcccgatcatggacggcagcgccgctccgtttgtatacctgctgcttgacgccggtatcgacgagttgaactgcgccaagaaatttgttcgcattaaagaaactgttcgtgtcgaagatggcgataagtgggctgaatttaagccgtacaatggtttttctctggatttcaccatcgattttaaccatccggctattgattccagcaaccagcgctatgcgatgaacttctccgctgatgcatttatgcgccagatcagccgtgcgcgtacgttcggtttcatgcgtgatatcgaatatctgcagtcccgtggtttgtgcctgggcggcagcttcgattgtgccatcgttgttgacgattatcgcgtactgaacgaagacggcctgcgttttgaagacgaatttgtgcgtcacaaaatgcttgatgcgatcggtgacttgttcatgtgtggtcacaatattattggtgcatttaccgcttataaatccggtcatgcactgaataacaaactgctgcaggctgtcctggcgaaacaggaagcctgggaatatgtgaccttccaggacgacgcagaactgccgttggccttcaaagcgccttcagccgtactggcataacgacatttatactgtcgtataaaattcgactggcaaatctggcactctctccggccaggtgaaccagtcgtttttttttgaattttataagagctataaaaaacggtgcgaacgctgttttcttaagcacttttacgcacaacttatcttcattcgtgctgtggacttcaggctttaatgataagatttgtgcgctaaataagtttgaatacgatcgggatggcaataacgtgagtggaatactgacgcgctggcgacagtttggtaaacgctacttctggccgcatctcttattagggatggtcgcggcgagtttaggtttgcctgcactcagcaatgccgccgaaccaaacgcgcccgcaaaagcgacaacccgcaaccacgagccttcagccaaagttaactttggtcaattggccttgctggaagcgaacacgcgccgcccgaattcgaactattccgttgattactggcatcaacatgccattcgcacggtaatccgccatctttccttcgcgatggcaccgcaaacgctgcccgttgctgaagaatctttgcctcttcaggcgcaacatcttgcattactggatacgcttagcgcgcttctgacccaggaaggcacgccgtctgaaaagggttatcgcattgattatgcgcattttaccccacaagcaaaattcagcacgcccgtctggataagccaggcgcaaggcatccgtgctggccctcaacgcctcagctaacaacaataaacctttacctcattttattaactccgcaacgcggggcgtttgagattttattatgctaatcaaattattaactaaagttttcggtagtcgtaacgatcgcaccctgcgccggatgcgcaaagtggtcaacatcatcaatgccatggaaccggagatggaaaaactctccgacgaagaactgaaagggaaaaccgcagagtttcgtgcgcgtctggaaaaaggcgaagtgctggaaaatctgatcccggaagctttcgccgtggtgcgtgaggcaagtaagcgcgtctttggcatgcgtcacttcgacgttcagttactcggcggtatggttcttaacgaacgctgcatcgccgaaatgcgtaccggtgaaggtaaaaccctgaccgcaacgctgcctgcttacctgaacgcactaaccggtaaaggcgtacacgtagttaccgtcaacgactacctggcgcaacgtgacgccgaaaacaaccgtccgctgtttgaattccttggcctgactgtcggtatcaacctgccgggcatgccagcaccggcaaagcgtgaagcctacgctgctgacatcacttacggtacgaacaacgaatacggctttgactacctgcgcgacaacatggcattcagccctgaagaacgtgtacaacgtaaactgcactatgcgctggtggacgaagtggactccatcctcatcgatgaagcgcgtacaccgctgatcatttccggcccagcagaagacagctcggaaatgtataaacgcgtgaataaaattattccgcacctgatccgtcaggaaaaagaagactccgaaaccttccagggcgaaggccacttctcggtggatgaaaaatctcgccaggtgaacctgaccgaacgtggtctggttctgattgaagaactgctggttaaagaaggcatcatggatgaaggtgagtctctgtactctccggccaacatcatgctgatgcaccacgtaacggcggcgctgcgcgctcatgcgctgtttacccgcgacgtcgactacatcgttaaagatggtgaagttatcatcgttgacgaacacaccggtcgtaccatgcagggccgtcgctggtctgatggtctgcaccaggctgtggaagcgaaagaaggtgtgcagatccagaatgaaaaccaaacgctggcttcgatcaccttccagaactacttccgtctgtatgaaaaactggcggggatgactggtactgctgataccgaagctttcgaattcagctccatctataagctggatactgtcgttgttccgaccaaccgtccaatgattcgtaaagatctgccggacctggtctacatgactgaagcggaaaaaattcaggcgatcattgaagatatcaaagaacgtactgcgaaaggccagccggtgctggtgggtacaatctccatcgaaaaatcggagctggtgtcaaatgaactgaccaaagccggtattaagcacaacgtcctgaacgccaaattccatgccaacgaagcggcgattgttgctcaggcaggttatccggctgcggtgactatcgcgaccaacatggcgggtcgtggtaccgatattgtgctcggtggtagctggcaggcagaagttgccgcgctggaaaatccgactgcagagcaaattgaaaaaattaaagccgactggcaggtacgtcacgatgcggtactggcagcaggtggcctgcatatcatcggtactgaacgtcacgaatcccgtcgtatcgataaccagctgcgcggtcgttctggtcgtcagggggatgctggttcttcccgtttctacctgtcgatggaagatgcgctgatgcgtatttttgcttccgaccgagtatccggcatgatgcgtaaactgggtatgaagccaggcgaagccattgagcacccgtgggtgaccaaagcgattgccaacgcccagcgtaaagttgaaagccgtaacttcgacattcgtaagcaactgctggaatatgatgacgtggctaacgatcagcgtcgcgccatttactcccagcgtaacgaactgctggatgtcagcgatgtgagcgaaaccatcaacagcattcgtgaagatgtgttcaaagcgaccattgatgcctacattccgccacagtcgctggaagaaatgtgggatattccggggctgcaggaacgtctgaagaacgatttcgacctcgatttaccaattgccgagtggctggataaagaaccagaactgcatgaagagacgctgcgtgagcgcattctggcgcagtccatcgaagtgtatcagcgtaaagaagaagtggttggtgctgagatgatgcgtcacttcgagaaaggcgtcatgctgcaaactctcgactctctgtggaaagagcacctggcagcgatggactatctgcgtcagggtatccacctgcgtggctatgcacagaaagatccgaagcaggaatacaaacgtgaatcgttctccatgtttgcagcgatgctggagtcgttgaaatatgaagttatcagtacgctgagcaaagttcaggtacgtatgcctgaagaggttgaggagctggaacaacagcgtcgtatggaagccgagcgtttagcgcaaatgcagcagcttagccatcaggatgacgactctgcagccgcagctgcactggcggcgcaaaccggtgaacgcaaagtaggacgtaacgatccttgcccgtgtggttctggtaaaaaatacaagcagtgccatggccgcctgcaataaaagctaacagttgaagtaaaaggcgcaggattctgcgccttttttataggtttaagacaatgaaaaagctgcaaattgcggtaggtattattcgcaacgagaacaatgaaatctttataacgcgtcgcgcagcagatgcgcacatggcgaataaactggagtttcccggcggtaaagttgaaatgggcgaaacgccggaacaggcggtggtgcgtgaacttcaggaagaagtcgggattaccccacaacatttttcgctatttgaaaaactggaatatgaattcccggacaggcatataactctgtggttctggctggtcgaaagctgggaaggggagccgtggggtaaagaagggcaacccggtaagtggatgtcgctggtcggtcttaatgccgatgattttccgccagccaatgaaccggtaattgcgaagcttaagcgcgtgtacgtcggataaggcgttcacgccgcatccgacatttgcacacgatgcctgatgcgacgctggcgcgtcttatcagtatctataattttaacacgttgatatgtaaggtcttgtaggtcgggtaaggcgttcacatcgcatccgacatttgcacacgatgcctgatgcgacgctggcgcgtcttatcaggccagcgtgcgacatcagacaaaatgtcactgctttggctcttcgctccagtcatcgctttcggaaagatcgccactgctggggattcgtttttcttcagcagcccattctccgaggtcgatcagctggcaacgtttggaacaaaatggccgaaacgggctgatttcaccccacaccaccgttttcccgcaggttgggcaattcaccgtaatagtttctgacatttttactccttagcaacaggccagttcgaaatccagacgttccggtacctgtccgttttcactgtccagcggcataaaacgaatggcaaaacggctcttatgaccggaaatttgcggataaagctgtgaatcgagtgacagattcaggcgcagcaagtcggcatcgccaccgttatcctgataaaaaccattcaggctggtttgtttacggaagggggccgactggcgaattaaatccagcaccatggtaagtgcctgggtaagcgggttcaggctggcaatccaggtttctacctggctgtcgcgctgcgcctggggtagatgcagccaaatgtgcaatgtaggtaaatcaaagctgcaacagccgcccgggatgctcagtcgctgacgcaccagagcaatcaaacgatcttcacgtagaaattgcccgatacgcggcgcggagattaatacgctccccgccgcttttaactgctgaattaatgcttcaatacggctctggtccacgccgggcacgccaatccaggtctggagtttacgttgctgccggtcaagttctttcaacagctcagtgcggacttcgccgcgctcgaaaacatccagtaattcgctgacattacggaagaaatgcagcgcgccagcgtggtcaacgatgggtaaattaacggtgagttgctgaatcaaaaactcaatgcgcagccatgtacgcattttttcatttagtggatgttcaaaaaggacctgggtctgcattacggtttttcctgtgagacaaactgcgacgcaagctgcaaatagtgtgcgtgcaggcgggcaacatccgatgcgatagcatccggtgcgccgttattatcaatgacgtcatctgccacggcaaggcgagcttcgcgcgttgcctgagcagcaaggatttgttcgacatgctcgcgagttacatcgtcgcgctgcatggtgcgcttaagttgcgtttctgggctgacatccaccaccagcactcgattcgcttttttatacagtgagttttctaccagcaatggcacaacccatagtacatagggggaagtagcttgctggatctggtgttgcgtctcttgctgaatcagcggatgcagcagggcgttaagccagtttttctcttccgggttggcgaagatccgctcgcgcaaagcccggcgctgcaatgttccatcagcagcaatcatgttagcgccaaagtgatcagcaatggcatgtagcgcaggtgcacctggttcaaccacctgacgcgcaataatatcggcatcaatgacgttaattccgagatcagcaaacgcattggcaacggtactcttgccactgccaatgcctcccgttaaggcaactatatacctcataatttatattcccgggaattcatcatgattatcaaaacgttaaaaatgagcgcacgaaagcgaaattgatgaaacgttcgctcactatttaccaggtaaatttatgggattgtagcgtaaaaaaagacaatttcgcagtcttgcgccgcattgattagtgcgtatgataacgtcactggagttgcgctcttacccttatagccattaaccccaggaatccgcacatgcgtattgaagaagatctgaagttaggttttaaagacgttctcatccgccctaaacgctccactcttaaaagccgttccgatgttgaactggaacgtcaattcaccttcaaacattcaggtcagagttggtccggcgtgccgattattgccgcaaatatggacaccgtaggcacattttctatggcctctgcgctggcttcttttgatattctgactgctgtgcataaacactattctgtcgaagagtggcaagcgtttatcaacaattcttccgctgatgtgctgaaacatgtgatggtttctaccggcacgtctgatgcggatttcgaaaaaactaaacagattctcgacctgaactcggcattaaatttcgtttgtattgacgtggcgaatggttattccgaacacttcgtgcagttcgttgcgaaagcgcgtgaagcgtggccgaccaaaaccatttgtgcaggcaacgtagtgactggtgaaatgtgtgaggagcttatcctctccggtgccgatatcgttaaagttggcattggcccaggttctgtttgtacaactcgcgtcaaaacaggcgtcggttatccgcaactttctgcggtgatcgaatgcgccgatgctgcgcacggtctgggcggaatgatcgtcagcgatggcggctgcaccacgccgggcgatgtcgcgaaagcctttggcggcggtgccgatttcgtaatgcttggcggcatgctggcgggccacgaagagagtggcggtcgcatcgttgaggagaacggcgagaaatttatgttgttctacggcatgagctcagagtctgcgatgaaacgtcacgttggcggcgttgcggaatatcgcgcagcagaaggtaaaaccgttaagctgccgctgcgaggcccggttgaaaataccgcgcgtgatattttgggcggcctgcgttcagcttgtacatacgttggggcttcacgcctgaaagaactgaccaagcgcaccacgtttatccgtgtgcaggaacaagaaaaccgcatcttcaacaacctgtaatataccaacgctggcgtggagcaacacgccagcgttatcccattccactcatcgcatcgcctaaatggaaaattggcagatacattgccaccaccagcgtaccgataattcctcccgttatgatcagcaacgccggttccagtaaggctgcgaggttatccgccagcgccattgtgttatcccgatgatgatgggcgaggttgtctaacatgagatccagcgagccggatgcctctcctgttctcactaattgtaaacagagcgggctaaactcaccggcattttttagcgccagccagatggggtgaccgttactgatatcgtgctggatttgtgtcagaagttgcacccagtacgggcagcgcattgtttctctgacgctctcaacgccctgtaaaaaagaaatgcctgcactttgtgtcagcgtcagaatcgtaaagatctgcgtgagtttttgtccccgcatcagtgaacccataatcgggatgcgtaacagcaatttctgccgtgcgataagcctggttgggtggcgcatcagcagcttattggctatcgccagcagaaagccgaatagcaccagcaaccaaccccattcgccactaaaacttgccagcgtcatgatcccctgcgttagcgccggtagcggagtgttaaaggtcttatagatagcggcaaactccggcagtacaaaatgcagcattgccacaaccaccatgattgccatcgctaaaatgataatgggataacgtaacgctgatttcactttgtcgatcaactgacgctgggctttttgctgacgcgccagttcaaagcagcattcatccagcttaccggtcagttcacccgtgcggatcatcgcctgatagagcggcggaaatacctctgaccagggtaataaggcattggaaaaggcaacgccctgttcaagatcgtgcgccagtgattgcagcaacgcttgccactgcttactgggatgctgttccgccagcagagccagtccttcagaaagcgttaacccggctttgagtagcgtcgccagttgatgaatgacttccgcgcttttatctcctcgccactgcgcagaattgatggcgattcgcttcaggcttagtggggtaaccatctgttgctgtagtgccatgagcagcaaagcacggctctctgcccatagcatcccatcttgcgcattgccgtcgccggttatgccatgccagcgccagagttgcttactcgccatgcggcatccccaatacgcggattaactcttcaacggtggttaagccttgctccacggccaggcagccgttttcaaaaagcgttcgcatacccgcctgtcgggcgtgcgtttccagcgattcaacgtcggtattagcggaaataagctgacgtatgaccggtgttataggcagaacttcaaataaggccgtgcgaccataaaaaccgtggtagcaatgtacacaaccgggtgcctgccagtggggcagcggcgacggccatacattgtctggaatatggatgggctccccttgctgccggcgacaatgcgggcaaagtttgcgtaccagacgctgggctattaccagcgtaagcgccgatgatagcatccagcgggcgactcccatttgctgtaaacgtaccagcgtttcgcaggtggaattagtgtgtagggtagacaacaccaggtgaccggtttgcgcggctttaatggcaatttctgccgtttcgccatcgcggatctctccgatcatgatgacgtcaggatcctggcgcaataacgcacgcaaaacgccctgaaaggtgagtccggcacgcgaatggatttgcgtctggtttagtccggctatggggatctcaaccggatcttcgacgctacaaatattaatgtcagcggtattcagcatttgcagggcactataaagcgtgaccgttttgccgctgcctgtagggccagttaccagcaccagtccctgtggttgttgcaaggcatgagcaaagtccaccagttgtgacggctgcattccaagcgtgttaacatccagtgcctggttcacctgctgtaacaaccttaataccagcttttcaccaccccgacatgctaaggtcgcaatacgaaatgagacggcgtttcctgccagttcgacagtgaattgcccgtcctgcggcaggcgatgttccgcaatatccaggtttcccagcacttttaatctggcggttaatgcgactccggcatccggtgaaacgtccggtaaaggatgcaatacgccgtcgatacgcaagcggatgcggtaggcattgtccgctggttcgatatgaatatcagacgcgcgttgttccagcgcagattgtaacgttcgagtcagcaactctgctttgggctgatgcttctcctgaacagctacgggcaatgtctgttgtgtgcgactggcgtgaccttccatttgttggcgtgtccagcaggtgatctcaatacgtttggtggtagcgaaatgcaatgcgtccagtagctcatgcgaaggtgcatcgactaccgcaacatgaaccacctcttcgctggcatccagcaagactccctgataacgcagacacagggcggtgagctgtggaatattcattgccgctccttagttggcgtcatcaaagcggaagacatcttcgcaggcttgctgcaatgcgctgtcactttgaatattgcagttgcgcgtccaaccggtgacgccgtttgcgttatcccaacccggcgtcatgacgacgcttagtccattgagactttcttgcccggtcagcgacaccacgccctttgccacactcatggctgaaacatagcgggtggtggtaggcgagggaatgccattgctgccaccgtcgcaggtatttaatccaccatgttccagcgcgcacaactctacggcggtacggtaaggcacaaaggtttgtagcatgtcggtgagtgcggctttgcgcaggtagttttgataagcgggaataccaatggcgcttaaaatggcaatgatgccaataaccaccatcagttcgataagtgtaaaaccgcgttgcttgtccatctgtttcgctccttgatttggttggcgctactttggcaaacgccatcagcacaagcgaggggcaaaaaacgaaacgggaaagcagcttccgaggttttttatttcgttgcagcgaaagacaagaaatttgcgaggcgttacgaagaaagttggggaaggggagatttatccgcccgcgatggagcggataaatctgttagcaattagcgaaaacgcattgaaaggtcgagtgcctgtacgtgtttagttagcgcaccaacggagataaagtccacgcccgtttcggcaaattcgcgcagtgttttgtcagtgacgttgccagacacttccagtagcgccttgccgttggtgcgtttgacggcttcgcgcatctgttctgtttcgaagttatccagcatgatgatatcggcacctgctttcagagcttcatcaagttcttccagattctctacttcgacttctactggcgcatccgggtgcaaccaggatgctttttcgaccgcctgccgcactgagccggaggcaataatatggttttctttgatcaggaaggcatcagaaagccccaggcggtgattcgctccgccgccgcaaagtaccgcgtatttcagagctgaacgcaggccgggcaaggttttacgcgtatccaacagttgcgtgttggtgccttccagtaattcgacatagtggcgtaccttactggcaactcctgaaagagtttgcacaaaattaagcgcagtgcgttcgcccgttaacagcacgcgagatgggccttcaagttcgaacaagggttgattggcgttgatgacatcgccgtcatccacatgccagataatggtgacatcgtcgcctgccagttgaataaacacctcttcaacccagcgtttgccgcaaaatacgccattctcgcgggtgatcactgtggcatgagagcgagagttttccggtaaaagttttgccgtaatgtcattgttggcatcgactgttccgcctaaatcttcccgtagcgcctgggccaccgcgccggggatatcgagattaatgcgttccagcagctcgtcacgtcgggtgtcagggttatagcggcgaggcggcatgttaaaactccagatagctaacgaatcataaggtagaaacatgctactctgaaccgggtattagcaccacatataaggagatcctgcatgttgttagaacaggggtggctggttggcgcgcgccgcgttccctcaccacattacgattgccgcccggatgacgaaacacccaccctgctggtggtgcacaatattagcctgccgccaggcgagtttggcggtccgtggatcgacgcattattcactggaactattgatccgcaggcacattctttctttgctgagatcgcccatttgcgcgtctccgctcactgtttgattcgccgcgatggtgaaatagtccagtatgttcctttcgataaacgtgcctggcatgcgggagtctctcagtatcaggggcgtgaacgctgcaatgatttttctattgggattgagctggaaggcaccgatacgctggcgtataccgatgcgcagtatcaacagcttgcggcggttacgcgggcactgattgatcgctatccagatatcgctaataacatgacgggccattgtgatattgcgccggatcggaaaaccgatcccggccctgcatttgattgggcacggtttcgtgcactggtcagcaaggagacaacatgacgctatttacaaccttactggtgttaattttcgagcgcctgtttaagttgggcgagcactggcagcttgatcatcgtcttgaagcgttctttcggcgggtgaaacatttttctctcgggcgcacattaggcatgaccattattgcgatgggcgtgacttttttactgttacgcgcattgcagggagtattgttcaacgttcccacgctgctggtgtggctgctgattggtttgctgtgtattggcgcaggtaaagttcgtcttcattatcatgcttatctgacagctgcttcacgtaatgatagccatgcccgtgccacgatggctggcgaactcaccatgattcacggcgtcccggcaggctgcgatgaacgtgagtatttgcgtgagctgcaaaatgcattgctgtggattaactttcgtttttatcttgctccgctgttctggctgattgtggggggaacctggggacccgttacgctgatggggtatgcgtttttgcgtgcatggcaatactggctggcgcgataccagacgccgcatcatcgtttacagtccggcattgatggcgtgcttcatgtactggattgggtgccggttcgtcttgcgggtgtggtatatgccttgatcggtcatggtgagaaagcgttaccggcctggtttgcttcgctgggtgatttccatacttcgcaatatcaggtattaacgcgtctggcacagttctctctggcgcgtgaaccgcatgtcgataaggtggagacgccaaaggcagcggtttcaatggcgaagaaaacctcgttcgtggtcgtggtggtaattgcgctactgacgatttacggggcgttggtgtaaagattattgccctcaccctgcacgggtgagggcgtagagagattaatgcgcttttacggctttggcggttttctctttaaacagatagccgatacctaacacgatcagccataccgggatcaggtataccgaaatcgccattcctggggtcatcagcataatcaccagtaccgccgccataaacagcaggcagatccagttacccagcggataaagcagggcagggaagcgagttaccacgccttgttcttgtttggcacgacggaatttcatatgcgccagactgatcatcgcccagttgatgaccagtgcagataccaccagcgccattaacagtccgaaagcggactctggggcaaggtagttaatcagtacgcacaatgccgtaaccagcgcagacaccagaatagtgttaaccggtacgccgcgtttatcgacagacgccagcgcttttggcgcgttcccttgttgtgccagaccgaacagcatacggctgttgcaatatacgcagctgttgtacacggagagcgcagcagtcagtaccacgatattcagcgcattcgctacaaaggtatcgcctaactcgtggaagatcagcacaaacggactggtatcggcggtaacgcgggtccacggcattagtgagagcagaacggctaacgagccaatatagaaaatcaggatgcggtagataacctggttagttgctttcgggatactttgctccgggttatcagcttctgctgcggtgatccccaccagttccagaccaccgaaagagaacatgataatcgccatcatcatcaccagaccggtgaagccgtgtggcaggaaaccaccctgatcccacaggttgctaacgctcgcctgcgggccgccgttgccgctgaatagcagccaggcgccgaagatgatcatcgctaccaccgcgataactttgataatggcaaaccagaactccatctcgccaaacacttttacgtttgtcaggttgatggcgttgatcaccacaaagaacacggcggcagaaacccaggttgggatttccggataccagaactgaatgtatttacccacggcagtcagctctgccatggcaactaaaacgtacagtacccagtagttccagccagaggcgaaaccggcaaaactgccccagtatttataagcaaagtggctaaaggagcctgcgacaggttcttcgaccaccatttcacctagctgacgcatgatcagaaaggcgataaaaccagcaatggcgtaacccaggataatccctggccctgcggactgtattacggaggcgctacccaggaatagccctgtccctatcgcgccacctagcgcgataagctgaatatggcggtttttaaggccgcgctttagctgctcgccgtgctgttgaccttccattatgaaacctcgtgttgtgttgtttttttgaactacgcagcaatgcgtgtgtaattttgtaattccgtttgttgtattggtttctttacattttatgtaactgaattatgatgatagtactttcaactatcacaagataatggtatatgcgcgagaatgcacctgctttatgtagatgtgttgattttctggataaaaaaaaagcaattgtaagtttttcatcacatttaatagatactttaagtctgataacatactgttttaactagctatatgtcggatttgtctgcctgctgaacaccatgccttagccaccagcacaataatcttacaaaaggtcatataagaataaatagatgttaataatacaatggggttgtaacgcgagtatttaaatataatattgcgagctaagtgaaaacgttaagtaattgaaataatttttcattaaaagcgtttcttattgatcgagaaataagttttctatttaatgcaaaaaagttaaggataaacgggaatgaaataaagtgggcgatattgtttacctgagaataatcggtgagaagcagggcgatatttcttcaggctgtgggacgtatgcgtcggttggtaatcgctggcaggttggccatgaagatgaaatttttgcctttgcactcaccaacgccattaccagtactggtaaaggcgttaatctacaggggctacaattttgcaaactcattgataaaagctcaccgctactgtctaatgccatcaatcagaatgagcggttatttattgaaatcgatttgtatcgtataaataaaagcaggcactgggaacggtattattatattcagctaagaaatgcttcattaactgctattcatgtaaacatttctgacaataatcttcctaccgaatgtgtaaatgttaattatgactacatattatgcaaacatctcatagccaatacggaatttgactggttggcctttcctgctggctataatagcttatttattccacctaaaaacccacctgccagtaatcttaaccctgagccgctaccagttgttaaccttccactctctccaccagcggttaaaccggtctatgccaaatcctgtctgaaggagaagggatgtacagatgccggaacggcagaagaacccgctgaaaacttcgggcaagtagcgatttttgctctgccagtggttgatgactgctgtggataccaccatccggaggctaacgatgttgggcaacccgcagaagctcaaaccatgctactgtttccgggtagtgtgttggcggctcaaatatggggaaaatggtcgctcagtggcatactcagtgcaacctgcggctcttacatcggtgcgttggcatctgctttgtatattccctctgcgggcgagggcagtgctcgcgtgcccggacgtgatgagttctggtatgaggaagaactgcggcagaaagcactagcaggcagtaccgccaccacccgggtacgttttttctggggaactgacattcacggcaagcctcaggtgtatggtgttcatacgggtgaaggtacgccgtatgaaaacgtccgcgtggcgaacatgcagtggaacgagcagacgcagcgttatgaatttacccccgctcacgatgtcgatggccccctgattacctggacgccggaaaatccggaacatgggtatgttccgggccataccggtaacgacaggccgccgctggatcagcccaccattctggtgacgccgattccggacggtacagatacctataccacgccgccattcccggttcctgatccgaaagaattcaacgattgtattctggtttttccggcgggatccggtattaagcctatctatgtttacctgaaggaggatccgcgaaagctgcctggtgttgtaacagggcgcggcgtcctgctttcaccaggaactcgctggctggatatgtcggtatccaataacggcaacggcgcaccaatccaggcgcatattgctgataaattgcgcggacgggagtttaaaacctttgatgagtttcgcgaggcgctgtggctggaggtgagtcaggatccggagttgatagcgcagttttcaagtggtaaccaaacacgtataaaacaaggattaaccgcaaaagcacctattgacggttggtattatggccctaaagaaatagttaaaaaattccagatacatcatcgtgttgcagttgaatatggcggcagcgtatacgatattgataatttacgaattgttacccccagactacacgatgagattcactacaggagataaatatgtttaaagaaaagctccaggattataccgaggatgaatttcttaattttttaggcggattgagatcatctatgaaagatggaaaatccttaaaaggtaaggagctagaaatgtactgggattcattagtagatcattttattgaaattacacagcatccgtcagggagcgatctaattttctaccctaaaagtcaaggagatgataagcctgaaaacatcctgaaaattgtcaaagaatggcggcgttcacaggggttacccttgtttaaagactctaaataaagtagataataaaactatatatggaacatcatcgcatctggctaatgcgatgatattaatgacataaaataataatgtgattgctcttaaaaaacaggtaaaaatactgaagcctcattaggttattttatcattttcccgcttttaccgataccctttggctggaggtgagtcagtatccggagttgatagcgcagttttcaagcggtaatcaaacacgtataaaacaaggattaatcgcaaaagcaccacttgaaggttggcattatggcactaaagaaatcgttaaaaaattccacatgtatcatcgtgttgcgattgaatatagtggcggaatttacgatattgataatttaaggagggcacacctcatttgcatgatgaaatttattacaggagatagttaaatgtataattttaaagatgaaatagaaggttacacagagcgggaattcattgagttgcttggcgagtttacaaatccaaccggggataacgctcaattaaaaggggaagagcttgacaaatattgggatgatctagaagaacatcttaccagaattacacaacatccgttgatgagcgatcttatctactatcctgcaaagaagggagatgatgaacctgaaaacatcctgaaaattgtcaaagaatggcggcgttcacaggggctacccttgtttaaagactctaaataaagtagataataaaactatatatggaatatcatcgcgtctggctaatgcgatgatgttaataacataaaataataatgtgggtgctcttaaaaaacaggtaaaatactgaaatttcattaggttattttatcaatttcccgctttcaccgataccctttggctggaggtgagtcagtatccggagttgatagcgcagttttcaactggtaaccaaacacgtataaaacaaggattaatcgcaaaagcgcctcttgaaggttggcattatggctctaaggaaattgttaaagaattccatatatatcatagtgttgcgattgaatgtggtggcgaaatttatgatattgataattaaaggattgttacgcctcgactacatgatgaaattcactacaggagataatgtatatgcatgatttaaaatataaaatatatttttacacagaaggtgaatttcttgaaatgcttgaggagatagtaaatgcaactagcaaagataaatccctaaaagggaaaaaattagaaaaatatctcgataccttagtggatcatttcattaaaattactgaacatcctaaaaagggagatctcattttctatcctaattccccagaagatggtaaacctgaaaacatcctgaaaatcgtcaaagaatggcggcgttcgcaaggattgcctttgttcaaagattcagaatgaactctaaacagaatctgtcacctgaaaatcatcacgttctggttaagtgatgattttcgctacgagaaggttacggtggcgattgcagtgataataagcaatgtaaaaagaaaacataggtaaatactacctttctctccttccctgaacattcattttacatattaattcacataattgaattgttatgcgttttgttgcttggtgaatcggttcagaggaaatattttttcgtttcaattctgttaaggtcaccccttgatgggtaaatttaacatttgtgcatagttacaactttgaaacgttatatatgtcaagttgttaaaatgtgcacagtttcatgatttcaatcaaaacctatatggacataaggtgaatactttgttactttagcgtcacagacatgaaattggtaagaccaattgacttcggcaagtggcttaagacaggaactcatggcctacagcaaaatccgccaaccaaaactctccgatgtgattgagcagcaactggagtttttgatcctcgaaggcactctccgcccgggcgaaaaactcccaccggaacgcgaactggcaaaacagtttgacgtctcccgtccctcattgcgtgaggcgattcaacgtctcgaagcgaagggcttgttgcttcgtcgccagggtggcggcacttttgtccagagcagcctatggcaaagcttcagcgatccgctggtggagctgctctccgaccatcctgaatcacagtatgacttgctcgaaacacgacacgccctggaaggtatcgccgcttattacgccgcgctgcgtagtaccgatgaagacaaggaacgcatccgtgaactccaccacgccatagagctggcgcagcagtctggcgatctggacgcggaatcaaatgccgtactccagtatcagattgccgtcaccgaagcggcccacaatgtggttctgcttcatctgctaaggtgtatggagccgatgttggctcagaatgtccgccagaacttcgaattgctctattcgcgtcgtgagatgctgccgctggtgagtagtcaccgcacccgcatatttgaagcgattatggccggtaagccggaagaagcgcgcgaagcatcgcatcgccatctggcctttatcgaagaaattttgctcgacagaagccgtgaagagagccgccgtgagcgttctctgcgtcgtctggagcaacgaaagaattagtgatttttctggtaaaaattatccagaagatgttgtaaatcaagcgcatataaaagcgcggcaactaaacgtagaacctgtcttattgagctttccggcgagagttcaatgggacaggttccagaaaactcaacgttattagatagataaggaataacccatgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggagtcaacgtagctgcaggcaccggtatcagcaactacatcaacaccatccccgttgaagaacaaccggagtatccgggtaatctggaactggaacgccgtattcgttcagctatccgctggaacgccatcatgacggtgctgcgtgcgtcgaaaaaagacctcgaactgggcggccacatggcgtccttccagtcttccgcaaccatttatgatgtgtgctttaaccacttcttccgtgcacgcaacgagcaggatggcggcgacctggtttacttccagggccacatctccccaggcgtttacgctcgtgctttcctggaaggtcgtctgactcaggagcagctggataacttccgtcaggaagttcacggcaatggcctctcttcctatccgcacccgaaactgatgccggaattctggcagttcccgaccgtatctatggggctgggtccgattggtgctatttaccaggctaaattcctgaaatatctggaacaccgtggcctgaaagatacctctaaacaaaccgtttacgcgttcctcggcgacggtgaaatggacgaaccggaatccaaaggtgcgatcaccatcgctacccgtgaaaaactggataatctggtcttcgttatcaactgtaacctgcagcgtcttgacggcccggtcaccggtaacggcaagatcatcaacgaactggaaggcatcttcgaaggtgctggctggaacgtgattaaagtgatgtggggtagccgttgggatgaactgctgcgtaaagataccagcggtaaactgatccagctgatgaacgaaaccgttgacggcgactaccagaccttcaaatcgaaagatggtgcgtacgttcgtgaacacttcttcggtaaatatcctgaaaccgcagctctggttgcagactggactgacgagcagatctgggcgctgaaccgtggcggtcacgatccgaagaaaatctacgctgcattcaagaaagcgcaggaaaccaaaggcaaagcgacggtaatccttgctcataccattaaaggttacggcatgggcgacgcggctgaaggtaaaaacatcgcgcaccaggttaagaaaatgaacatggacggcgtgcgtcacatccgcgaccgtttcaatgtgccggtgtctgatgcagatatcgaaaaactgccgtacatcaccttcccggaaggttctgaagagcatacctatctgcacgctcaacgtcagaaactgcacggttatctgccaagccgccagccgaacttcaccgagaagctggagctgccgagcctgcaagatttcggcgcgctgctggaagagcagagcaaagagatctctaccactatcgctttcgttcgtgctctgaacgtgatgctgaagaacaagtcgatcaaagatcgtctggtaccgatcatcgccgacgaagcgcgtactttcggtatggaaggtctgttccgtcagattggtatttacagcccgaacggtcagcagtacaccccgcaggaccgcgagcaggttgcttactataaagaagacgagaaaggtcagattctgcaggaagggatcaacgagctgggcgcaggttgttcctggctggcagcggcgacctcttacagcaccaacaatctgccgatgatcccgttctacatctattactcgatgttcggtttccagcgtatcggcgatctgtgctgggcggctggcgaccagcaagcgcgtggcttcctgatcggcggtacttccggtcgtaccaccctgaacggcgaaggtctgcagcacgaagatggtcacagccacattcagtcgctgactatcccgaactgtatctcttacgatccggcttacgcttacgaagttgctgtcatcatgcatgacggtctggagcgtatgtacggtgaaaaacaagagaacgtttactactacatcactacgctgaacgaaaactaccatatgccggcaatgccggaaggtgctgaggaaggtatccgtaaaggtatctacaaactcgaaacccttgaaggtagcaaaggtaaagttcagctgctgggctccggttctatcctgcgtcacgtccgtgaagcggcagagatcctggcgaaagattacggcgtaggttctgacgtttatagcgtgacttccttcaccgaactggcgcgtgatggtcaggattgtgaacgctggaacatgctgcacccgctggaaactccgcgcgttccgtatatcgctcaggtgatgaacgacgctccggcagtggcatctaccgactatatgaaactgttcgctgagcaggtccgtacttacgtaccggctgacgactaccgcgtactgggtactgatggcttcggtcgttccgacagccgtgagaacctgcgtcaccactttgaagttgatgcttcttatgtcgtggttgcggcgctgggcgaactggctaaacgtggcgaaatcgataagaaagtggttgctgacgcaatcgccaaattcaacatcgatgcagataaagttaacccgcgtctggcgtaagaggtaaaagaataatggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagtaccatctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcggcagcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttcctgctccgtttgcaggcaccgtgaaagagatcaaagtgaacgtgggtgacaaagtgtctaccggctcgctgattatgatcttcgaagtcgcgggtgaagcaggcgcggcagctccggcggctaaacaggaagcggctccggcagcggcccctgcaccagcagctggcgtgaaagaagttaacgttccggatatcggcggtgacgaagttgaagtgaccgaagtgatggtgaaagtgggcgacaaagttgccgctgaacagtcactgatcaccgtagaaggcgataaagcttctatggaagttccggctccgtttgcaggcgtcgtgaaggaactgaaagtcaacgttggcgataaagtgaaaactggttcgctgattatgatcttcgaagttgaaggcgcagcgcctgcggcagctcctgcgaaacaggaagcggcagcgccggctccggcagcaaaagctgaagccccggcagcagctccggctgcaaaagccgaaggcaaatctgaatttgctgaaaacgacgcttacgttcacgcgactccgctgatccgccgtctggcacgcgaatttggcgttaacctggcgaaagtgaagggcactggccgtaaaggtcgtatcctgcgcgaagacgttcaggcttacgtgaaagaagctatcaaacgtgcagaagcagctccggcggcgactggcggcggtatcccaggcatgctgccgtggccgaaagtggacttcagcaagtttggtgaaatcgaagaagtggaactgggccgtatccagaaaatctctggtgcgaacctgagccgtaactgggtgatgatcccgcatgttacccacttcgacaaaaccgatatcaccgagctggaagcgttccgtaaacagcagaacgaagaagcggcgaaacgtaagctggatgtgaagataaccccagttgtcttcatcatgaaagccgttgctgcagctcttgagcagatgcctcgcttcaacagttcgttgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctggggactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaagtaaaagagccggcccaacggccggcttttttctggtaatctcatgaatgtattgagattattagcgaatagacaaatcggttgccgtttgttgtttaaaaattgttaacaattttgtaaaataccgacggatagaacgacccggtggataatgggcgtcataaaaaaaacgtcagacccgccggagataaatatatagaggtcatgatgagtactgaaatcaaaactcaggtcgtggtacttggggcaggccccgcaggttactccgctgccttccgttgcgctgatttaggtctggaaaccgtaatcgtagaacgttacaacactcttggcggtgtttgcctgaacgtcggctgtatcccttctaaagcactgctgcacgtagcaaaagttatcgaagaagccaaagcgctggctgaacacggtatcgtcttcggcgaaccgaaaaccgatatcgacaagattcgtacctggaaagagaaagtaatcaatcagctgaccggtggtctggctggtatggcgaaaggccgcaaagtcaaagtggtcaacggtctgggtaaatttaccggggctaacaccctggaagttgaaggtgagaacggtaaaaccgtgatcaacttcgacaacgcgatcattgcagcgggttctcgcccgattcaactgccgtttattccgcatgaagatccgcgtatctgggactccactgacgcgctggaactgaaagaagtaccagaacgcctgctggtaatgggtggcggtatcatcggtctggaaatgggcaccgtataccacgcgctgggttcacagattgacgtggttgaaatgttcgaccaggtcatcccggcagctgataaagacatcgttaaagtctttaccaagcgtatcagcaagaaattcaacctgatgctggaaaccaaagttaccgccgttgaagcgaaagaagacggtatttatgtgacgatggaaggcaaaaaagcccccgctgaaccgcagcgttacgacgccgtgctggtagcgattggtcgtgtgccgaacggtaaaaacctcgacgcaggcaaagctggcgtggaagttgacgaccgtggtttcatccgcgttgacaaacagctgcgtaccaacgtaccgcacatctttgctatcggcgatatcgtcggtcagccaatgctggcacacaaaggtgttcacgaaggtcacgttgccgctgaagttatcgccggtaaaaaacattacttcgatccgaaagttatcccgtccatcgcctataccgaaccagaagttgcatgggtaggtctgactgagaaagaagcgaaagagaaaggcatcagctacgaaaccgccaccttcccgtgggctgcttctggtcgtgctatcgcttccgactgcgcagacggtatgaccaagctgattttcgacaaagaatctcaccgtgtgatcggtggtgcaattgtcggtactaacggcggtgagctgctgggtgaaatcggcctggcaatcgaaatgggttgtgacgctgaagacatcgcactgaccatccatgcgcacccgactctgcacgagtctgtgggcctggcggcagaagtgttcgaaggtagcattaccgacctgccgaacccgaaagcgaagaagaagtaatttttcgtttgccggaacatccggcaaattaagaagcggctattctggccgcttcagattgttgataaagtgctcgtggttgatgccggatgcggcgtaaacgccttatccgacctacaaaatcatgcaaattcaatatattgtatggcttatgtaggcccgataagcttgcgcatcgggcgattcgatgtttgtcatcagtcttaagcggctaacaacgccgcttttttacgcctgcaatttacctttccagtctccttgctccacgctcagacaaccgttcgcgtaccgctgaccgttgctcattattcaatcgggcagtatggttactgtcgtttagacgctgcgggcggctctcctgaactttctctcgaaaaacctgacgctgctcaggcgaggcagactggatacgctgacgtgctgcatctctttgctgttgattctgcgggttagtctgcattttctcgcgaaccgcctggcgctgctcaggcgacgcggactgaatacgctgatgtgccgcttctcttctctgctgattctgcgggttagcctgaattttctcgcggactgcctggcgctgctcaggagaagccgactgataacgctgacgagcggcgtccttttgctgctgggtcagtggttggtggtggctgaagtcgcggaagtcgtcataattgccatagtgttccgcttcattaaaccgctgtgccgcagcctgacgctgggtatctcgcgtagtgactggtgctgcgtgtgttcgttgctgaaactggcttgctgccgcctgacgctggctgtcgcgtgttggagcaggtagcggcgtggcgctcattccgcctttaacatcggtttggtgaaaccgttttgtcatatcctgatcatgataaggcataccattacggtagtttggattgtgccgccatgccatattcttatcagtaagatgctcaccggtgatacggttgaaattgttgacgtcgatattgatgttgtcgccgttgtgttgccagtcattaccgtcacgatgaccgccatcgtggtgatgataatcatcatcgtcatgatgatgatggtcatgatcatcgtcgtcccagtcgatgctgctgaatagtgcgtatgtggtagcaacgcccatgctatagccgaatccgcgcacaaagctgtcaacaaacggttctccggctggcggcggcagataaactggcggataagcggtattggcccaactgccgtaaaccacgtttgggttgtagttcggaatataaaccacatccggattggctggctcaatggttattacggtcggtgcaggttctgcgacgacggggctggacgtagaaacggtatttgattgtgtggcaggggcgttggcgggctgatttaccggtacgacttttttcgttgtcgtgatgatcttttgttcagttgatgacttcagcgagccggtttgttgcgccagttgccgcaatcgctgtaccgagtccatcacgtcctgcggctgcgccagaaaagcatcgcccaggttttgcacccattgcgggttttcgcccatcaatgccatcaactgtggaaaggccaccagtgatttgacgctggcgtcccagggctggtcggatacagcctgaatagcagcatcgccttgtttaagtggattatcgtgtgaccattgcactgcttgagcaacgtttgccggataggttgatgccattaacacttgtgaaagcagagagtcggggtacagcgcgacgggcgcgacccattgatcgatttgtgcagtgctgaatgcggatttgacgacggcaggtgttacaggaggcacggaaaccgttgcaggaagcgtaactgcggagatgtcaggcgcagtctgttgtgtcgattgcgcttccacaggcgcttccactgtgcggctttttatatatagcccggcagaggcggcacaaagcccggcactgcaaattagcgccagcacatggggtttaaacggcaaagtcattttcataattcggatctcaaggaaatcgcaatggtcggcgaactgccacccgcaggtgctgtgaatccgagtataaagaggcggtagtttaaattttgactaatcttgggattcgttgagaaaggtgattatcaccatgcgaattaacgaagtttttacggagggaaacattctctagactatctttaacgattcagccacttttttatgttgcttttttgtaaacagattaacacatcgtcaaaatcctgctattctgcccgttgcggtactgggcatttaccctacaaactgctgtctcacaggagcgtgaagagaatcgcctgccgcactatgacaatgagagcgaggagaaccgtcgtgctagaagaataccgtaagcacgtagctgagcgtgccgctgaggggattgcgcccaaacccctggatgcaaaccaaatggccgcacttgtagagctgctgaaaaacccgcccgcgggcgaagaagaattcctgttagatctgttaaccaaccgtgttccccctggcgtcgatgaagccgcctatgtcaaagcaggcttcctggctgctgtcgcgaaaggcgaagccaaatccccgctgctgactccggaaaaagccattgaactgctgggcactatgcagggtggttacaacattcatccgctgatcgacgcgctggatgatgccaaactggcaccgatcgctgccaaagcactttctcacacgctgctgatgttcgataacttctatgacgtagaagagaaagccaaagcaggcaatgaatatgcgaagcaggtaatgcagtcctgggcggatgccgaatggttcctgaatcgcccggcgctggctgaaaaactgaccgttaccgtcttcaaagtcactggcgaaaccaacaccgatgacctctctccggcaccagatgcgtggtcacgcccggatatcccactgcacgcgctggcgatgctgaaaaacgcccgtgaaggtattgagccagatcagcctggtgttgttggcccgatcaaacagattgaagctctgcaacagaaaggtttcccgctggcgtacgtcggtgacgttgtgggtacgggttcatcgcgtaaatccgccacgaactccgttctgtggtttatgggcgatgatattccacatgtgccgaacaaacgcggcggtggtttgtgcctcggcggtaaaattgcaccaatcttttttaacacgatggaagatgcgggtgcactgccaatcgaagtcgacgtctctaacctgaacatgggcgacgtaattgacgtttacccgtacaaaggtgaagtgcgtaaccacgaaaccggcgaactgctggcaaccttcgaactgaaaaccgacgtgctgattgatgaagtgcgtgctggcggccgtattccgctgattatcgggcgtggcctgaccaccaaagcgcgtgaagcacttggcctgccgcacagcgatgtgttccgtcaggcgaaagatgtcgctgagagcgaccgtggcttctcgctggcgcagaaaatggtgggccgtgcctgtggcgtgaaaggcattcgtccgggcgcgtactgtgaaccgaaaatgacttctgttggttctcaggataccaccggcccgatgacccgtgatgaactgaaagacctggcgtgcctgggcttctcggctgacctggtgatgcagtctttctgccacaccgcggcgtatccgaagccagttgacgtgaacacgcaccacacgctgccggacttcattatgaaccgtggcggtgtgtcgctgcgtccgggtgacggcgtaatccactcctggctgaaccgtatgctgctgccggataccgtcggtaccggtggtgactcccatacccgtttcccgatcggtatctctttcccggcgggttctggtctggtggcatttgcagccgcaacaggcgtaatgccgctggatatgccagaatccgttctggtacgcttcaaaggcaaaatgcagccgggtatcaccctgcgcgatctggtacatgccattccgctgtatgcaatcaaacaaggtctgctgaccgttgagaagaaaggtaagaaaaacatcttctctggccgcattctggaaattgaaggtctgccggatctgaaagttgagcaggcatttgagctgacagatgcgtctgccgagcgttctgctgccggttgtaccatcaagctgaacaaagaaccgatcattgaatacctgaactctaacatcgtcctgctgaagtggatgatcgcggaaggttacggcgatcgtcgtaccctggagcgtcgtattcagggcatggaaaaatggctggcgaatcctgagctgctggaagccgatgcagatgcggaatacgcggcagtgatcgacatcgatctggcggatatcaaagagccaatcctctgtgcaccgaatgacccggacgacgcacgtccgctgtctgcggtacagggcgagaagattgacgaagtatttatcggttcttgcatgactaacatcggtcacttccgtgccgctggtaaactgctggatgcgcacaaaggtcagttgccgacccgcctgtgggtggcaccgccaacgcgtatggacgctgcgcagctgaccgaagaaggctactacagcgtcttcggtaagagtggtgctcgtatcgagatccctggctgttccctgtgtatgggtaaccaggcgcgtgtagcagacggtgcgacggtggtttccacctctacccgtaacttcccgaaccgtttgggtactggcgcgaatgtcttcctggcttctgcggaactggctgctgttgcggcgctgattggcaaactgccgacgccggaagagtaccagacctacgtggcgcaggtagataaaacagccgttgatacttaccgttatctgaacttcgaccagctttctcagtacaccgaaaaagcggacggggtgattttccagactgcggtttaataagtaagcgcacgcgctgcgcataaacgacacaatgcccggtgaatgagattcccgggcattttttatttctaaaccatcgccgttccgctgtttttctccggtaaggctgcgataattacatcaatggcgcaatgcgatttcggcgcattgccgggagcagaggaacacactatggattacgaatttctgcgcgatattaccggagtggtaaaggtgcgcatgtccatggggcatgaagtggtcgggcactggtttaatgaagaggtgaaagaaaacctggccttgcttgatgaagtggaagacgcagcgcgcacgctcaaaggcagcgaacgatcctggcagcgggcagggcatgaatacactctgtggatggacggtgaagaggtgatggttcgcgccaatcaactggaattcgctggcgatgaaatggaagaggggatgaactactacgatgaagagagcttgtcgctgtgcggcgttgaggattttcttcaggtggttgcggcttaccgtaatttcgtgcagcagaagtaagtaaatcaggcggagcctccgtgctccgcctgagacgttaaacagcgggcatattgcgcccgtaataaatctcgcgcatttctttccacagcgcagcggtaatttcctggcgctcgctgtcggttaaatcttccggtttggtgtggaacatgtagtgcttaaggtcgaactctttaagcaacatcttggtatggaagatattttcctgatagacgtttacatccaccatgtcatacagcgccttcatatcgtcagacataaagttctgaatcgaattaatctcatggtcgataaagtgcttcataccgttaatgtcgcgggtaaaaccgcgcacgcgataatcaatagtcacaatatcggactcaagctggtggatcaggtaattcagcgccttcagcggagaaatcacgccgcaggtagagacttcaatatcggcgcggaaggtacataaaccgccttcaggatgactttccgggtaggtatgtacgcaaatatgacttttatcgagatgggcaacgaccgtttctggcagtgggccggggtgttctgttttgtcgataagtttcgggtcgaccggttcttcactcaccagaatagtgacgctggcaccttgtggctcgtaatcctggcgggcgatgttaagaatattggccccgataatggaacaggtttctgacaggatttcggtcagacggttggcattatagagttcatcgatataagcaatataaccgtcgcgctcttcggtagttttggcgtagcagatatcgtaaatacaaaaactcagacttttggtcagattattaaagccatgcagtttcagttttttcaatttcttatcttctccttaggacggctgtgaagccagtgcatcttgcagatactggggtaaggcaaaagctgccgtatggactgccggattgtaataacggcatttcaggccagaagcgagaaaacgcgcctgaataatttcggttgagagatggcgtaaggcgtcgttatctgtcgcccatgcaaaggtcatgatgccgccgtaataggtcgggatcgccgcctgataaaagccaacatcgctgaagtaatggctgagtttgcgatggctgtcgatggcctcttcctgctgtaaaaagcagacgccgttttgtgcgacgaagataccggcaggattcaggcaacgtttgcagccttcataaaatgcagaagtaaacagactttcgccgggaccgataggatcggtgcagtcggagataatgacatcaaaggtctggctggtttgattaacgaaattgacaccatcgtcgatcaccagtttaaagcgcggatcgtcgtaactaccggcgttatggttgggaagatactgacggcagaacgacacgacacccgcatcgatttccaccatcgtgattgactcaacgtttttatgtcgggttacttcacgcagcatggcaccgtcgccgccgccgataatcagcacatgtttcgcgtgaccgtgggccagtagcggaacatgggtcatcatctcatgatagataaactcgtcacgctcggtggtttgtactacaccatccagcgccattacgcgaccaaatgcggcgttctcaaaaatgatcagatcctggtgatcggtcttttcatgatacagaacgttatctaccgcaaagtactgcccaaactggtcgtgtagcgtttcatgccactgttttttttcggccatgggttgatacctcctttgttaacacccgtaaaaaaatggcgcaacataatagctaacattgaccgcggatgcacggtcaatatttctacaaaaaggtatcagggattatttgacgtaggcaagcaggcttaaggaatcgcgggccagggctttgcactttttagcgacgggaatgccaatgccgctgagatcgcggtagctgtcttcaccgagggctttcatgtcgaaggtgtcgtaattactgagatcccactggttttgctgggcgaaaaagaccagcgcgcgacgaatttgcccgttaggtaagttctggtaaccacaatcgttcttcagaaaaacaaaaactgccgttaaatcggccatatcttcggcttcagactcgctgagcgcgtaactgtttgcgcaaacggccatcaggctgccgaataacactgttctgaaaaacgtcttcattgcttctaccaggggcttaaagaagataaacgttagcacactgcgagcgaggcgacgaccattattgtcgattaaattgtgtctgcggcttgaccttcccgtaaggggaaggactatgctcaacgtttgattttgtttcgcctgcttaagaataaggaaataactatgcaacgtcgtgatttcttgaaatattccgtcgcgctgggtgtggcttcagccttgccgctgtggagccgcgcagtatttgcggcggaacgcccaacgttaccgatccctgatttgctcacgaccgatgcccgtaatcgcattcagttaactattggcgcaggtcagtccacctttggcgggaaaaccgcaactacctggggctataacggcaatctgctggggccggcggtgaaattacagcgtggcaaagcggtaacggttgatatctacaaccaactgacggaagagacgacgttgcactggcacgggctggaagtaccgggtgaagtggacggcggcccgcagggaattattccgtcaggtggcaagcgctcggtgacgttgaacgttgatcaacctgccgctacctgctggttccatccacatcaacatggcaagaccgggcgacaggtggcgatggggctggctggtttggttgtgattgaagatgacgagatcctgaaattaatgctgccaaaacagtggggtattgatgatgtcccggtgattgttcaggataaaaaatttaacgctgacgggcagattgattatcaactggatgtgatgaccgccgctgtgggttggtttggcgatacgttgctgaccaacggtgcaatctacccgcaacacgctgccccgcgtggctggctgcgcctgcgtttgctcaatggctgtaatgcccgctcgctcaatttcgccaccagcgacaatcgcccgctttatgtgattgccagcgacggcggtctgctacctgaaccggtgaaggtgaacgagctgccagtgctgatgggcgagcgttttgaagtgctggtggaggttaacgacaacaaaccctttgacctggtgacgctgccggtcagccagatggggatggcgattacgccgtttgacaagccgcatccggtaatgcggattcagccgattgccattagtgcctctggtgctttgccagacacattaagtagcctgcctgcgttaccttcgctggaagggctgacggtacgcaagctgcaactttctatggacccaatgctcgatatgatggggatgcagatgctgatggagaaatatggcgatcaggcgatggccgggatggatcacagccagatgatgggccatatggggcacggcaatatgaatcatatgcaccacagcgggaagtttgatttccaccatgccaacaaaatcaacggtcaggcgtttgatatgaataagccgatgtttgcggcggcgaaagggcagtacgaacgttgggttatctctggcgtgggcgacatgatgctgcatccgttccatatccacggtacgcagttccgtatcttgtcagaaaatggcaaaccgccagcgacgcatcgcgcaggctggaaagataccgttaaggtagaaggtaatgtcagcgaagtgctggtgaagtttaatcacgatgcaccgaaagaacatgcttatatggcgcactgccatctgctggagcatgaagatacggggatgatgttagggtttacggtataaaaagaccgtattcggaaatatgcccggatctctccgggcattatggttacttcacatcatccggcaacgcataagccacaatatagtcgcccatcttcgtaccaaatgaaccgtgaccgcctgcggagatcactacatactgcttgccattcacttcataggtcattggcgtagcctgaccacccgctggtaaacgaccctgccacagtttttcaccgttgctcatgttgtaagcgcgcaggtagttatctgccgtagcggcgataaacagcacgttacccgccgtggagattggcccgccaagcatcggcatacccatattgaacggcaccggtacaggcatcgggaatggcatactgtcctgtggcgtaccaatacgtttcttccacaccacttcattggttttcagatccaatgctgagatatagccccatgctggttgtttacatggcagaccaaacggtgagaggaacgggttgagcgtgacaccatacggtacaccgtactgcggctggatgccggattccgtacccgtgcctttggcatctttcggctgttccatcgggttgcctggaccgcgtgggatcagtttcgaaacaaacggcagtgccattgggttggcaatcgccacttcacgattcggatcaacggaaatcccgccccattcgaacatccccagattacccgggaagaccagtgtaccctgttcagatggcggcgtaaaaatgccttcatagcgcatctggtggaacatcacgcggcacaccaactggtcaaacatggtggcaccccacatatccgcaccgctcaaatctttcgtcggacggaagctcagttccgagaagggttgagtaggggtcacgtaatcgcctttggcagcaccttggggaaccggtttttccggggccggaaccaccagttcaccattacgacgatcgagcacaaaaatgttgccggttttcgccggagcgtaaataaccggcactttctgaccattaacggtgatgtccgccagcgtcggctgtgccggaagatccatatcccacaggtcgtggtgaacggtctgatagctccacgccagtttcccggtagtggcattcagcgccagaatcgagctggcataacgttcctgttccggtgtgcggttaccaccccagatatctggcgtggtgacgcccatcggcagatagaccagatccagcttcgcgtcataggccgctggtgcccacgagtttggtgagttaaaggtaaaggtgtgttcgtcagacgggatcgcattcggatctttcgcgcccggatcaaaagcccacagcagctccccggtgttgacatcaaaaccacggatcacgccagacgtttcgcgggttgagaagttgtcggtgactgaaccggccatcacgatggttttatcggtgataatcggcggcgaagtcggttcatacagacccggtttggtgtccggcatattgctttgcagattgagcacgcctttattggcgaaggtttcgcacagcttgccgttttcagcgttaattgcaatcagacgaccatcattgaccggaagaatgatacgacgcgggcaatccgccatcacttccggcgaagcagtttctgctttggcttcatgataagagacgccacggcaggttacatgctggaaggactcgttggttttcagctcaggatcgtaatgccatttctctttaccgctggcggcatccagcgcaaacagacgttgatgcgcggtacacaggtaaagggtgtcgcccactttaattggcgtcacttcattggtgatttcgcccggatcgttcggctgcttcacatcgccagtacggaacacccaggcttctttcagcttgtggacgttatcagcgttaatttgcttcagtggtgaaaagcgttgaccttcctgattgcgaccataggcaggccagtcctgatcggcaacgggggagatggcttctgctggcgtggtatcggcgcttaaggtgccgctgatttcctgcggatcgttaaatccggcccaggtcaggataccaccgctaatcagcagtgcgaccaccagtgcggcaactgcgccgctggcaggaatgaccaggcgacgccagacaaacggcaggatcagccagatgccgaagaagaccagaatgtcgctgcgcggagtcagcgcccagaagtcgaaaccaacttcccagacgccccaaatcatagtgccgagcagcagggctgcgtacagccaaagcgcggcgcgtttactgcgccacagcatccaggcgacgccgagcatcacaaggccagcgatagggtagtaccaggagccgccaatcgcgaccagccagcctccgccaatgagtagatacagcccgcaaagcgctgcaaaaagggctgttagcgtgacgagtaatcgccgcgagccggtattgttaattgccataaagagacaccatttcaattcattaatattttagtagcaattaattataggttttaacatgtgtgatcgtcatcacaattcgagctttattaacagattccgcgaatgaatagttttactggtatactgcgtgtcttgcgctttgttgcggtgctgaaacctgcccgtgcgaagtgatttgtttttaaatcatatggttatagatatgaaacatactgtagaagtaatgatccccgaagcggagattaaagcgcgtatcgccgaactgggtcgtcagattactgagcgttacaaagacagcggcagcgatatggtgctggtgggtctgctgcgtggctcatttatgtttatggcggacctgtgccgtgaagttcaggtatctcatgaagtcgactttatgaccgcctccagctacggtagcggcatgtccaccacccgtgatgtgaaaatcctcaaagatctggatgaagatatccgtggcaaggacgtgctgattgttgaagatatcatcgactcggggaatacactgtcgaaagtgcgtgagatcttaagcctgcgcgaaccgaagtcgttggcgatttgtacgctgctggataaaccgtcccgtcgtgaagtgaacgtcccggtagaatttatcggtttctcgatcccggatgagtttgtggtgggttacggcattgattacgcacagcgttaccgtcatctgccgtatatcggcaaagtgattctgctggacgagtaagtgtgaagttgccggatgtgttgcatccggcatggcgaatttatttgtgattgatgtgcttcagcttgaggttggagatcccgtgacggtaacgttgctcaagggtttcgcggttagtcgctgtgacatccagatcacgcagcaagccgtcgtgaatgccgtaggcccagccgtgaatggtaactttctgcccgcgtttccacgctgattgcataatggtggagtggcccaggttatacacctgttccatgacgttcagttcacacaaggtatccagacggcgctcttgcggcatttcgccgagcaatgagctatgtttgaaccagatatcgcggatatgcagcagccagttgttgataagccccagttccgggttttcaactgcggcttgtacgccgccgcaaccgtagtggccacagataataatgtgttcaacttcgagtacatccactgcatactgaaccacggaaaggcagttcaggtcggtgtgaatgaccaggttagcaacattacggtgaacaaagagttcgcccggctcaagaccggttaaacgttctgcaggaacgcgactgtcggaacatccaatccatagaaagcgcggtttttgcgcttgtgccagtttctcaaaaaacccgggatcctcttccaccagcatttttgaccatagtgcattgttgctgatgagtgtatctatgtctttcatggaggttaacgacctgtaaccaaataattacgtttggctaatatagggcaactccgggacgatttaaaccacagataaagtgtaagaacgtaaggtaagtaaaaatttatgaccattgcactggaacttcaacagcttaaaaaaacctatccaggcggcgttcaggcgcttcgtggaatcgatttgcaggtcgaagcgggtgatttttatgcgcttctcgggccgaacggggccggaaaatcgaccactatcggtattatcagctctctggtaaataaaacctccgggcgggtcagcgtatttggttacgatctcgagaaagatgtcgtaaacgctaaacgtcagttgggtctggtgccacaggaatttaacttcaacccgtttgaaaccgtgcagcaaattgtggtgaatcaggcagggtactacggtgtggagcgcaaagaagcgtacattcgcagcgaaaagtatcttaaacaactcgatctatggggaaaacgcaacgaacgtgcgcgtatgttatctggcgggatgaagcgccgtttaatgattgcccgtgcgttaatgcatgaacctaaactactgattctcgacgaaccgaccgcaggcgtggatattgaacttcgccgctcaatgtggggctttttgaaggatttaaacgacaaaggcaccaccatcattctcaccacacactacctggaagaagcagaaatgctgtgccgcaatatcggcattattcaacacggtgagttggtggaaaatacttcgatgaaggcgctgctggcgaagctgaaatcagaaacctttattctcgatctcgcaccgaaaagtccgttaccgaagctcgatggctatcagtatcgactggtagataccgccacgctggaagttgaagtgctgcgtgagcagggcatcaacagcgtatttacgcagttaagtgagcagggcattcaggtattaagtatgcgtaacaaagctaaccgtctggaagagctgtttgtttcactggttaatgaaaaacaaggagatcgcacatgatgcatctttactgggtggcgctaaaaagcatctgggcgaaagagatccatcgctttatgcgtatctgggtgcagacgctggtgccgccagtcatcaccatgaccctttactttattatcttcggtaacctgattggttcgcgtattggcgatatgcatggcttcagctacatgcagttcatcgtaccggggctgatcatgatgtcggtgatcaccaacgcctacgctaacgtcgcgtcatcattttttggtgccaagttccagcgtaatattgaagagctgctggtagcgccggttccgactcatgtcattattgccggatatgtcggtggtggcgtggcgcgtggtctgtttgttggtattttggtgacggcaatttcactgttttttgtgccgtttcaggtgcattcgtgggtattcgttgccttaaccctggtgctcactgcggtgctattctcccttgcgggtttgctgaacggcgtgtttgccaaaacgttcgatgacatcagcctggtgccaacctttgtgttaacgccactcacgtatttgggcggggtgttttactccctgactttgttgccgccgttctggcaagggctgtcgcacctgaacccaatcgtttatatgatcagtggtttccgctacggcttcctcggtatcaatgatgttccgctggtcactacctttggcgtactggtggtctttattgtggcgttttatttgatctgttggtcgctgatccaacgtggacgtggtttgcgtagctaaggctatttcctctcctctggatttgggggagaggagttttgacggctatcaccctttatcaacaatggtcagggtagactgattttcggctaaggaggaaggcgatgttaggttgggtaattacctgtcacgatgaccgggcgcaagagatactggatgcgctggagaaaaaacatggggcacttcttcagtgccgggccgtgaatttctgtcgcggattaacctctaatatgctcagccgcatgatgtgcgatgccttgcatgaaacggactctggtgagggcgttatctttttaaccgatatagccggagcgccaccgtaccgcgtggcttcattattaagccacaaacactcccgttgcgaagtgatttctggtgtcacgttaccgttaattgaacagatgatggcttgccgtgaaaccatgaccagttcagcgtttcgcgagcatattgtcgaactgggtgcgccggaggtgagtagtctttggcaccaacaacaaaaaaatccgcctttcgtcctcaaacataatttgtatgagtattaacccgcgattctgatgacgcttttgctacaataaaagcgttgtttcaccctcggttattttttcatgtacaaacaagctgttattctcctgctgatgctgtttaccgcaagcgtcagtgccgcattacctgcccattatatgcaaaccatcgaaaatgccgcggtctgggcgcaaattggtgacaagatggtgacggtggggaatattcgggccggacaaatcattgccgtggagcccactgccgcaagttattacgtatttaattttggctttggtaaagggtttatcgataaaggccatctcgagccggttcaggggcgacaaaaagttgaagatggtttaggtgacctcaacaagccgctgagtaatcagaacttaataacctggaaagatacgccggtttataacgcgccgagtgtgggcagtgcgccatttggagtactggcggacaatttgcgctacccgattttgcataaactgaaagacaggttaaatcaaacctggtatcagatccgcattggcgatcgactggcctatatcagcgcgctggatgcccaacccgataatggcttgccggtgctaacctatcaccatattttgcgcgacgaagaaaacacccgttttcgccatacttcgacgaccacctcggtacgcgctttcaataaccagatggcctggctgcgcgacaggggatacgcgacactgagcatggcgcagctggaaggttacgtgaagaataagatcaatctccctgcgcgagcggtggtaattacctttgatgatggcctcaagtcggtgagccgctatgcgtatcctgtgttgaaacaatatggtatgaaggcgacggcgtttattgttacctcgcgcatcaaacgtcacccgcagaaatggaacccaaaatcgctgcaatttatgagcgtttctgaacttaacgaaattcgcgatgtatttgatttccagtcacatactcattttttgcatcggatagatggttatcggcggcctatattgctgagccgtagtgagcacaatattctgtttgattttgcacgttcacgccgcgctctggcgcaatttaatccacatgttttgtatctttcttatccatttggcggatttaatgacaaagctgtgaaggcagcaaaagaagccggatttcacctggcggtgacgaccatgaaaggcaaagtaaaaccgggggataatccgttgttactaaaacgactttatatcttaagaacggattcgctggagacgatgtcgcggctggtgagtaaccagccgcagggataacaatcaggcaacctgtaccggaatcgctttcgcggtacgtttcatttcgttgtcgccttcaaaataggcgacgttgggtcgccaggtgcgagcttcttcatctggcatggtaacgaagctggcgatgatgacaatatcgccgacgctggcgcagtgggccgccgcaccgttaacagaaataattctcgaaccgcgttctgccgcgatggcataggtggagaaacgcttgccgttggtgacattccagatatcaatggcttcgttttcgagaataccggctgcgtcaagaaaatcctgatcaatggcgcaagaaccttcatagtgcaggtccgcatgagtcactttcacgcggtggagtttgccctgcagcatcgtgcgaatcataacttctacctttctaccctgtcgttaacgaagcaggcgatgcctgctttgaggaaattctcacgcagtattgcccgatttttgtttagtgtctactcatctgacggcatttgcagcagcagtttgcgtaccgtgccgaagcgtgccatgtaacgcctgtaaccaattgaaatttatctgaacgctgctcggtaaacactaaagaggcggctgacgacggcacaccatgactggatactgccttcacgcaagaccacacggaaggcagggaagatggatgcaccgagtaccacaccgcatgatgcggtgtttaaacaatttttaatgcatgcggaaacggctcgcgactttctggatatccatttgccagcggagctacgcgaactgtgtgacctcgacacgctgcatcttgagtcggggagttttattgaagaaagcctgaaagggcacagcactgacgtgctctattccgtacagatgcagggtagtacgggttatctgcatgttgtgattgaacaccaaagcaagccagataagaaaatggcctttcgcatgatgcgttattctattgctgccatgcaccggcatctggaggctgatcacgataagctgccgctggtggtgccaattctgttttatcagggcgaggccacaccttatccgctatcaatgtgctggtttgatatgttttactcaccggaactggcgcgacgcgtctataacagtcctttcccgctggtggatatcactatcacaccggatgacgaaatcatgcaacatcggcggattgcgattctcgaactgctgcaaaaacatattcgccagcgcgacttaatgttattgctggagcaactggtcacgttgattgacgaagggtacactagcggaagtcagttagttgccatgcaaaactatatgctgcaacgcggtcatactgaacaagcggatttgttttatggtgtggtgagagacagggaaacgggaggggagtctatgatgacgctggcgcagtggtttgaagagaaagggattgaaaaaggaatggtgaaaggaatggagaaagggattgagcgggggattgagaaaggaatggtgaaaggaatagagataggaattgagaaggggattcagcagggaagacaggaagtaagtcaggaattcgccctgcgtcttctgagtaaaggaatgtctcgggaagacgttgcagagatggtaaatttacctcttgctgagattgataaaatgattaactaagttgtctgcattatgaataattgcctacagataacgtggcaatgaataactggcgccatcagccgtagcgccagttaagcattacgccagttcgaccagtttgttgtcgatcaggcgagcatcgccaagccaggcggctaccagaatcaccgctcgtttgctgttttcagagatttccagcaaggtgtcggcatcgcgaatctgaatatcatcggaacggaaacctttttcattcagttcttgcccggcaatagcaataatttcatcgagatcccgttcgccagcctgcaatttgtcggcaattgaacttaagactttgtagagacccggcgcaattttacgttgttccgccgtcagatagccgttacgggaactgagcgccagaccgtctttcgcgcgcataatcggcactccgacaatctcaatatcgaagcccatatcggcaaccattttgcggatcagtgccagttgctgaaaatccttttcaccgaagcaggcgatatctggctggaccaggttgaacagcttgctgacaatagtcgaaacgccgcgaaaatgtcccggacggctggcaccttccagcatggtggaaagaccgggaacatcaacataggtgtgggtttcagtaccgttcgggtagatctcttttaccgaaggcgcgaaaactaaatccactttacgtttgttcagcttttcgcagtcctcttgcaaggtccgtggataacgtgccagatcttccgggcggtcaaactgcattgggttaacgaaaatactgacgacgaccacatcggcgcgggctttggcttcgtcgaccagcttcatatggccatcgtgcaggttacccatggtgggcaccagcgccacgcgcttaccttccatacgcaggcggcgaatttgctgacgcagcagcggcagggtttcgataattaacacaacgtcactccttaatggaaactgtgttcttcgcccgggtaaacgccggactccacttcagccatatactgccgcacagccgcgcggatgtcgcccgtttcggcgaggaaatttttggcgaatttaggaatatgaccgccggtaatgccgaacgcgtcgtgcatcacgagaatttgcccgtcagtgacgttgcctgcgccaataccgataaccgggattgccagtgcttcggtaatgcgttttgccagctcaaccggcacgcactccagtaccagcagttgtgccccagcagcttctaaggctaatgcatcgctgagcagtcgatcgcccgcttcatcgccgcgcccctggactttgtagccaccgaaaatattcactgactgtggggttaggcctaaatgaccacaaactggaacggcacgttcggtcagcatttgtacggtttccaccagccactcaccgccttcaattttgaccatgttggctccggcacgcattaccgttgcggcgttttcaaaggcttgttccggcgtggcatacgccataaatggcaggtcagccagcagaaggcagtttggcgcgccgcgacgcacagcggcggtgtgataggcgatatcggcaacggtaaccggtagcgtggagtcatgcccctggaccgtcatgcccagtgaatcgcctaccagcatgacgttaatcccttcatcggcaaacagttttgcgaagctatagtcgtaagcggtgatggttgcgaaacgttttttgtcctgcttgcatttctgcaatgaagcaatcgtggttggtttcatagcgtatcctgataaatgatgttgtgctgtctcgcattttatcagtcacattggtgggggcaatgatttatccgtatcgcaccgccgttgtctggcggtgcgatagtgttatcaggggtaggtaacctgaaaagtgctggtggctttaaaatcccccggttctatagcaatattaccgtcttgttttaatgtagcctggaaatgaagaggttgagaggtcccaccgttgccattatccgggaaaatccccccagtagtgtcattttctgtttcataatctttataaatagacgttgcatcatttggtttcagtaccatttgtgcacttttagtgttttttaaaccttcaatcagtacaccaacgccttttgctgcgtcatttcctgtgagtgtgttagccaaaagttctttgcttacactacccaccttgtttgacttgagttttgtttctatattgcgaacacgaatacagttctgtagcgtgatatcaaaaggaaccgctgttgcgccattttttatttgtgcagggctataatcacccattttaaccgttgaaccacttaccgatgggccactaagcgcagcagtaaaacaggtagggtttgttaatacgatatctgtcaagtcaaagtcgattttaagaaaataactcttgatactaacgccagcattatatgctttgaatgagtagagataactatctgttctggataatgttacccgttgattcgttgtcgggttaaagtcggtatcggtataaaattcaatcgtgagcgtttgcataacgccaccaacggcccagtattttttgctgctattcgcgttgttgcaagaccaatatagggtttgctcgctttcgccacgccagttaaaagattggctcgtagaatcgccaatatacatgcctgatgggttgatatcagtagatgtaagtgttgaccaaatgtttgatattgctaacgtgtaatacaggcctggaacagatgtcttaaagagtttatgtccgccataactttttccggaatcaaccattttatgttcaatagacattggtgcgccgcttgagttactactcctgttacagtaaaggaaacctccacccgaagcggaatctaactgcgcccattttaatgacaccccggttgggccaagttgggttggtttataaaaaactaaattattggtgcctgaaccataccggaatttgacggtaacatctccattgggacctgtctctcgccattttggtctgatggaccaacaccgtaattattcccaacaatatagccgacgtcatcatcggtgccggcgcttgctgtataacaacaagagcatagtgctaaaaaaagaaagtatctgaagaatgtcttcatttttactccattgtcatgctgcaagataatacttgtagcactttgtctgttattcgtagtagatatccactaacacatggcttatcagtgggccagaggtgacattcagtgctggatcgattttttgcattcgggtactaaatttccaggatgaattatttagtgctgatgacatgaccggataaacggaacgtgagctaccagtggcactaagaacgttgaaggtatttgccgggtcctgaatagaaaatataactaccccaacatttttagccccggcgttgtcttcattagcgaatatttgactggaacctgtcgccattacgccactaagtgcgcgaaaattaatatgtaactgatttaacacattccctgtgccctgaagtgtgcagtcctgtactgtaatagtgaactcttttccaccggggtgataattttcggctgaaatgtttccggtaaaatcgcccacgccaacgacacctaaatcaatatttccgttgttgctgattccactttggcaggtgttattttttatatttgcaacaatgtcaacatcctgtcctgcaaccacaggggaagtggcgctgaatagcaacgacagaatcagaattgattttttcatcagattacgttgagtgggacgcatatttagttcctgaatcagtctgcctgttagttataagtcacggtgaatgttgctggggcagtgaaatcacccgcagtgacatttgtgacagttttatcttttgcgaccaccaacaccgcactcattgggtaatcgacaacattgctgcccgtcgcattagcaatactgacttcttctgttgcgggggtgacacaactgaattgtttagcgccgttcttacctggtgtggatgtgctccagacctcaacggcgaccgccgctgcttttgctgttgccgttgatgcgttagcaaatccaggaccattattagaattaccttcacataatgctcgtgtagtcaattttattttggcctttttcccgggaatccccgcacagtctttgaactgtaatttgaaggttttaattttagtttcggcattaatttcagaaatatatacatcaccgaaattgatggtggaaattttagttgtaccgtcatcagtcaacgttgatgtacaggtacccatttctacgtcagtagtaacagtcaggccaatactgtcagtggccgcatgtgaggaaatggttaacagtgatgaagccagaaatagactacccgataatccataacataatttttttaatatcatcattgtcatccttgttattgatagctgaagttaaaagttgccagtgcgcgaaacttgcctggaacacctttccctacacttgtttcacgcagtgcgacagtcatctcaagtccatcggtgctaatttctgatgcactccaacgtatatattctgcgctattaggtttcagaaatgtatcgcctgaagtcgccttccttttaaatcccattccgatatagcttgtggtggaggttgtatcactggccagggggataattagcgcgggtgaacttcctgattgatttcctgtcagggttgtatcaatccagctaattccactgctgcatccattggctaccaatttaaagttggcttcagattgtgctgttttattggctattttatccattcccatcgagggaataactaaggtgtacttatcatttccattatcagtgacattagttccggtaagtgtaatattacaggttgttgctttcacggtagcggtaaaatcgacattaacatccgttgcaaataccgaaggcgataacaatagtcccatgagtattgttattttatgtggtgtgatttttatcattggaagtcccttgtggttactgtatctgacaacgaagtccgttcataataatagattgtgctattttttctgatgtcgtgttttgttgataatgagcaaaacaactgaccggtttgccctcttcaatccaggtaattcgtatatttccttcctgcccgataccgcgaacaaaggcctgaccaccctgacctacgttgccgatgatattgttttgttcatcataaatatccgctgcaaatggaatatttttaccatcgcttcgcacgatgttcataattgccgattgtccctgaactgtttcaaaatcagcaaagacgacggctccctggcgcgggacggcgacagtactggtgcttttcaattcaacatcgttttccagatcgttaatgtccagtgcgatacgattttcatggtatggcgaaagggcgctggtcacaccataaccccagcggtctacggtgctgtttccgtagttaatacgagcgccttttgctcctggcgcctgaatgacagccagagtgtcggaatcactaaaactgtcattactgaacgtcagcccgccgctatgtaacacaaatccaccatcagtattgagtgagaattggcgactattatcactgcttgctgaggctgaacctgacagcgttccccacggcgattcataactggcataaccgccgatataactcaaatcatcactggatttattcatcatataacccgtgtttacgctgtagctgatgcgattggtatcgctgtaaccactactgctgatattgagttggttattacccttaaagtcgctgtttaattgtgtatcaatactctggaagccggagctgcggtgttccgtacccagtaaattttctattggaatcgtgaagctgagataaatgctatcgtcggtttgaccatcttcattcaacgaacgttgagcactgatactgtaactgccccaggacgcactattgctataaccaatagagtaattagtactgttttgcccggaggcccagtaatctgaccagcttcccgagagataaaatgaaccgtaatcctttttctcaaatttcagcggttggttgatactgaccgtgacctgatttttcatgcgcgagtaattgcgcatggatttaggttcaagctcttgctcaggatgttctacttcatcaatcagcgtcagcgcatcattgaggcccagatagtgctgggtggagtagcgataggccgcgatatttaatgatgtactggtattttcaaataacttgttccaggaaatacggtagctttgtccttgataggttttatcgtccggaatgctgacatttgagtgagtaacatcgacagaaaaagcccccacgggggtattcataccaagccccagcaatccggcggtgtagttattatcagttagctgaataccggtatatcctgtcaggtagttattcaaaccatagtagtagctggcttgaaataaattaggctcatcctggatactgtcttttaaaacctgaccggcgctaatatcccagcgaccaacgccagggcgcagcatttgcacaacagatgaaaatggctgggagaacgtccgttttgtgccatcagcttcttcgatagtcacaatgaggtcactgccataacctgacgggctaagatcgtcaatggcaaaggcccctggcggcaccgtcgtttcatagattttataaccattttgcataacggttactttggcattggtattcgctacgccatgaatgattggcgcaaaactggctaataccggaggcagcattcgactgtcactgtataagcgaataccgcgaatactgactgaatcgaaggtttcgccggttgtgtaagattcaccaataaccagttgtgaacgtagtgacgcaagatcgcgttgtaaatagcgattctgaaaatcgtaatcgctatggacattggtcatccagttgtagttacccgaggcacgtaaccgccaggcacctaagtttatcccaccgttgaatgccgcatagatactgtcatttgttctgcctggactttcactgtgatatccgttgaggttgtaggaaagcatggctgcattaatgccattttcccacaaagagggatcaacatagttttgataattcttcataatccatgcctgggggacatcgatatccaggcgttgatcgttaacatcgtaacgaatggatgattgagggatcatttcagccagattgaggcaatcaccaagatcttcgtctcgcttaagcaaaatggctttttcgctattcttgtctggtgaactgatatgaaattgcaataaatttttctgcgtaatgcaggcctgagcgttctttttaccttcaataacagcaaaagcaatgctttggctcatgatgggttgatcgttaacatacacactgacatcgtaaatgccaggtagtgtgggattgccttctgtataccgactaaggtcgatatttgaagcatcctttcccatcagaaatgtatggtcatattcgacgagttcagcgcataaagcactattgctatacagcagagcgcaaaacgtggcgatgtgggtaaggtgattagtagatttaatagtcacgttctgcttcctgctgtgttatatccttgccagattaaaggttggcgttgccttcaatagatccaccaaaatcattaatggcgaaaaaatgcacttttgcagagcttgttctgccactcatcccatttaccttgatgacgtcgttactgaacggcgcaatcattgtcatatccaggggatagcgtttgccgttggcttctaaatcaccactgctaaaagagacatagtagggcgtagggttatcaacgcgtaatgctgctttgccttcagatgttgcccaggaccacttcagagccaatggtgcatcagatgaaattccactcaatccttccgggcgatagaacagttttatacgtgtgcgaaatgccagttgtagcaggctttgatttgctgcttttgctgcatcgggttttggtggaacttccagtacgttaaaccagaacacactttctctgtcttttggcagagcactactggcggtgtacatcagtttgattgtttggccacgtttagcatcaatacgtgatactggtggcgtagcggtaaaggggacagtaatactgcctggttcagcgttatcatctccagtatctaaccaactctgaaccagcaatgggttattgcctttattttccagacgtacattgacgcttttttgttcgcttttataaactacgcgtgtacctgaaattacgatgtctgcaatagctgatgagctaaaagccatacagctcgctaagcacaatgctgcggtatgtttagtattaaaaaacataaaccattccttacagaattaattaaaacagggaataattatcaaaagtaaaaatatttgatgttattccctgtatatattcacccgatcaatttaagcggttgatatttactggtaagtaatggtatatgctgagttggtttttacataaccggcagtagctgctttgcttgcatccgcacgaacataggatgctttaaaatcgtaggttgcagatttagacgttgaatccagagttttgctgtaaacatcacccggattattgacctgaacctgtttaatagtagaaccttcaatattgtgcagagcgatatttacgccgtcagacggggtgttaatagacatgtcgttgttcagtgttcctttgctgttaccaaagaaaacagaaccgaaggtcatttttgcagtagtacccggagccgggttagctttgctgcagtcaatagtaatgctgaatggtttagctttagcacctacagtggtatccagtacaccatcagtaatttcagcaacagtagcggtttgcagcaggatcagaccgtctttgttaccgccatcaacacgagcttcacaagtgttatcaacgaccagaccgctaatatttaattgaccgccgtccatatcgttagcagcaaatgcagtaccagcagccattgccaacataataccggacagcgcaaaacctaattttttagacataaaaatccttgagtaatattccataaagcagataacagcattgcatgatgatgagattttgatgcaatgccatgtaactgaacgttactttgttaatgatgtttgtttgttttttactaagtattacattcattcatcattgggacagctattttgcataatgccatgacatatgcaatttaattttactaaatatgaaaattagttaaattaactttaaaaaattaagggagtggtgtatggaattagaatttcgggaaggtatattatattttctgtgtttttatttatcttaaatatattattatttgcaatagcttaaggttatttttcggaatatatttatattcacacgaaaaataattaccacttatctaattcattaaagccttttgcctgtagagcttcaactaatgataagccatcaggaaataccaattccggcgcaatttcaaacagtggccacagcataaagccgcgatttttcatatcgtagtgcggaacggtcagacgttcggtatttattacttcattaccaaacagcatgatgtcgagatccagcgtgcgcggtccccagcgttcagctttacggacgcgaccttgctgcaattcgatacgttgtgtgtgattgagtagctcttcaggggcaagagtggttttcagcgcgacggcggcatttaagtaatcgggttgatcttgcggccccagcggtggggtgcggtaaaacgaagaaacagcaagaatgcggctttctggaatatcgcctaatgctttcagggcagcattgacctgctccagcggagaggccagattgctgcctatggcaatatacgccactgtcatgcggtaccctcacgacgcggtgcgcgtttgcgtggacgacgagtacgacgacgcggtgacggttcttcatccagttcgttaagcatccctttttggtctggtggcgcggaaacctggaactcaccccaccatttcaccagacgttgcagttcagcgttacgctcaacttcggctcgtaaggccaacaggtcgtatgccgcacggaacttaggatgctccagcagtttccatgcgcgtttaccctgacgacgggacatacgcaactgcaactgccagatatcgcgggttagcgtggtcagccgtttcgggatcgccagtgaacggcaggcttcgtccagcacgtcgttcatcgccagtgcgaaagcgtcgtgataggtcaggccgctttcctgggcgatcttctgtgccgtctccagcaatgggtaccagaacatggcggcaaacaggaacgccgggttcacgcgcatatcgttatggatacgcgtatcggtattcttcagtacctgctcaataatgcgttccatcgggctgtcgccattttccgtgaagtagcgggtaatggtcgggaacagcggctggaacagatgatattcacacagcagcttataggtttcgtaaccgtagcccgcttgtagcagtttaagcgattcttcaaacaggcgtgccggtgggatatcgttcagcagggtagcgaggcgagggatcggttctgcggtttccgggctgatgcgcatgcccaatttggcggcaaaacgaaccgcgcggagcatacgtaccggatcttcacggtagcgcgtttccgggttaccaatcagacggataacgccgtctttcagatccttcatgccgccaacgtaatcacggacggtaaaatctgccacgctgtaatacaggctgttgatagtgaaatcgcggcgctgggcgtcttcttcgatggagccgaaaatgttgtcgcgcagcaacatgccgttttgcccgcgttgggaggtcgtgcggtcgctgacgttaccttcgtgatgtccacggaaggtcgcaacttcgataatctccgggccaaacatcacatgagccagacggaaacggcgacccaccaggcggcagttacggaacagtttgcgcacctgctctggcgtggcgttggtggtcacgtcaaaatctttcggctttttgccaagtaacaggtcgcgcacgccgccgccaaccagccaggcttcgtatcccgctttattgagcctgtacattaccttcagggcattttcactgatatctttgcgggaaatagcatgctgctcacgcgggatcaccgtcacctgtggacgggcgactgcctgttcagcctcgctttcctcgcggcttagcaccttgcggcaaaaattagcgactcgggtaaaaatagtacacctcggtagtgtcaaacatcattcaggacaaaaaaatagcggctaatcatagctcagcatgacgcatttgagaatgttgaatttacaattgccgactcaggcacggcggtaagccgccagtttttgacggctgactgaaggatttgctcgacgctgaaatcctgccagtgtgtttctacctgctgacccagaaaatgaagtgccgcgattaacaccgggcgcggatcgcctttcggcaacgcaggcgcatgattctgcttggaaagtttagcgccttgtggattaagcgccagcggtaaatggatgtaatctggcactttccagccaaaaagctggtacagcgagatttgccgcaccgtcggttcgatcaaatctgccccgcggacaatttcgctcacgccctggaagtgatcatccaccaccaccgccaggttataggcaaacaaaccatcacggcgatgaataataaaatcttcccgtgccagtttttcgtcggcgtgaataatgcctcgcagcagatcagtaaactgggtgaccggatgctgctggcggatacgtactgcggcgttgtctggtccatgatgcaaatcccggcaatgaccgtcgtaaataccgccaatgctttgaatacgcgcacgcgtgcaggtgcagtaataacttagtccttgctcatgtaaccaggcgagtgcttcgcgataggcgtggtgacgttgcgattgccagagaacgtcgccgtcccagtacaggccgtaatgttccagctggcgcaggatagtttctgcggcaccgggaacttcacgaggcgggtcgatatcttcaatgcgtaccagccagcgaccttgccgggcgcgagcctgcaaatagctgccaagcgcagcaatcagagaaccaaaatgaagctcgccggaaggagagggggcgaagcggccaatatagtgtgtgtctgtcatctctttgaacaaaaaataaggcgggagcatttcccgcctgtggtaaacgtgatggaacggctgtaattagccagccatctgtttttcgcgaatttcagccagcgttttgcagtcgatgcacagatcggctgtcgggcgcgcttccagacggcgaataccgatttcaacaccgcaggattcgcagtagccgaaatcttcgtcttccacttttttcagcgtcttctcgatctttttgatcagcttacgctcgcgatcgcggttacgcagttcgaggctgaactcttcttcctgggctgcacggtctaccgggtccgggaagttggctgcttcatcctgcatatgtgtaacggtgcgatcgacttcatccctgagttgattacgccatgcttccagaatacgacggaagtgcgccagctgggcttcattcatatactcttcgcccggcttctcctgatatggttccaccccagcgatggcgagaatactcagggacgatgttttacggttttgcccttcttgcatgttgcttctccttaacacgcactatcgatccccatgttcgggggaaaaatgaggccgctataaatagcagatgcttttccggatagcaattatctaaacgtaacacttgacaactgtgtgaggaaaagcgtatttgcgcacgcgaccagaatgtaaattaaccagttacttactctactacaatgtaaccggtagtgattttttaagagccatgccttcggcagaaagttccgctttgtaagccagaatttctacccccctctgttgagcttctgacaatagttgcgcgtatttctcatcgatgtggcgcgcgggtgaaaaccgtgtaatggctgaatgcagcacggcgaaaaagataaccgcacgctggccttcagccgctacgctcatcaactcccgaaggtgtttctgacctcgttcagtgaccgcatcgggaaaatatccctgttcgttctccgctaacgtaaccgatttcacttcaatatagcagtctggacgcgaatccgcctgcaacataaagtcaatacggctgcgttcggcgccgtattttacttcgcttttcagcgagctatagcctgccagctctgaaattgattcattaaggatagcctctttcgtcaacctgttagcccaaagcgtattgacgcaaataattgcgccgctctggctttgagttaattcccaggtgtgtgggtatttccgtttggtgttgtctgaagtcgaataccagacggtatcgccaggcgttgcacaaccggtcatcgcacccgtattcgggcagtgtagcgttaattcgcgaccatcgggtgtgatcacatcggctaaaaaacgtttgtaacgctgaattagcgtcgcgcgctgtagagggggagaaaattccattgcgacaatccttgttattgcgttagcgcccagcgttttagcggcgtgtagcgtgtgcgtccacgggcaaacgaggaggcgtaaagggtgaactccgtcaccgtatacgaccagttaaaacctggcggcgggattgtcaccgcctcgctggcgtcgcgcaataaggtaatatgtggatgaaacggacgattgctttgaaaacaaccgctgcgggcagcctgtgagcggagcatattcgccagctggattaagccgcgaggcggctgtcgcatccctaaccacaccacacgcgaacgcagccattgaccggcgtcatcaagcgtgagtgtgaaaccaggttgacgaatccgtccggctaaaagagaaagcgccttctctttctctgcgctcacttcgcctaaaaatgccagagtcagatgcaaattatcggcggcgaccggacgtcccgcctcaggtgggaagtgtgtggcgcgccagcggataatctgttcgcggatttctgcaggtaagtcgatagcaaagaacagccgttgcggttcagacatgtgaggcactcggttatgaattaccgcgatgctacaatgtggcgcgaagaatgttaaccctctggagcgttttgtgtcgtcgttgcccgttgctgccgtcttacctgagttacttgctgccctcgatggtgcatcgcaggtgttattaagtgcgccgaccggggccgggaaatcaacctggctgccgctgcaactgctggcgcatcccggcattaacgggaaaattatcctgctggagccgcgtcgtctggcggcgcgtaacgttgcgcaacgactggcggagctgcttaacgaaaagccaggcgataccgttggctaccggatgcgtgcgcaaaactgcgtcgggccgaatacccgcctggaagtggttaccgaaggcgtgctgacgcggatgatccagcgtgacccggaactgagtggtgttggattggtgatccttgatgaatttcatgagcgcagcttgcaggcggatttggcattggcgttgttactcgatgtgcaacaaggtctgcgtgatgaccttaaactgctgattatgtcggctacgctggacaacgaccgcttgcagcaaatgctgccagaagcgcccgtcgtcatctcagaagggcgctcgtttccggttgaacgccgttatttgccgctgcccgctcatcagcgttttgacgaagccgtcgcggttgctaccgccgaaatgctgcgtcaggaaagtggatcattactgttatttttacctggcgtcggagaaattcagcgtgtgcaggaacaactgacttcacgcatcggcagtgatgtgttgctctgcccgctgtatggcgcgttgtcgctgaacgatcagcgaaaagcgatcctcccggcaccgcaagggatgcgcaaagtggtgctggcgaccaatattgctgaaacaagtttaaccatcgaaggtattcgtctggtggtggattgtgcccaggaaagggtggcgcgttttgatccgcgtacagggcttacgcggttgattactcaacgcgttagtcaggcgtcgatgacgcaacgtgccgggcgtgccgggcgtctggagccgggtatctgcctgcatttaatcgccaaagaacaagcagaacgcgctgccgcgcaaagtgaaccggagatcttacaaagcgatctttccggtttgctgatggaattactgcaatggggatgcggcgatccggcgcagatgagctggctggatcaaccgccaacggtgaatctactggccgcgaaacgcctgttacagatgctgggggcgctggatggcgaacgcctaagcgcgcaagggcaaaaaatggcagcgctgggtaacgatccgcgtttagcggcaatgctggttagcgcgaagaacgacgacgaagctgctaccgcggcaaaaattgccgccattctcgaagagccgccacggatgggcaatagtgacctgggcgtggcgttttcgcgcaatcaacccgcctggcagcaacgtagtcagcaactgttaaaacgcttaaacgtacgcggcggtgaggcagacagttcgcttatcgcgccgctacttgccagagcgtatgccgatcgcattgctcgtcgccgtgggcaagatgaacgctatcaactggcgaacggcatgggggcgatgctcgatgccgacgatgcgctaagccgccacgaatggttgatcgcaccgttattattgcagggcagcgcctcgccggatgcgcggattttactggcgctgccggtcgatattgatgagttagtacaacgctgcccgcagctggtacagcagtctgacactgtggcgtgggatgacgcgcaaggtacgctgaaagcctggcgtcggctgcaaattggtcagttgatggttaaagtgcaaccgctggcgaaaccctcggaagacgagttgcatcaggcgatgcttaacggcattcgtgataaaggtttaagcgtgctcaactggacggcggaagcggaacagctacgcttgcgtttgttatgcgccgcaaagtggttgccggaatatgactggccagcggttgatgatgaaagtttgttggcgacgctggaaacgtggctactgccgcatatgacaggcgtacattcgctacgcggcctgaaatcactcgatatttatcaggcactgcgtggattacttgattgggtaatgcagcaacgtctggatagtgaattgcctgcgcattacactgtgccgacgggaagccggatcgccattcgttaccatgaagataacccgcccgcgctggcggtgagaatgcaggagatgtttggtgaggccactaatccgactatcgcccaggggcgcgtaccgttggtgctggagttgctttcccctgcccaaaggccgctgcaaatcacgcgtgatttgagcgccttctggaaaggagcgtaccgtgaggtgcaaaaagagatgaaagggcgttatcccaaacatgtctggccggacgacccggcaaacaccgcaccgacgcgacgaacgaaaaagtattcgtgaagaccaaagcaaatttgagagatatcttcttctgtcttgcaacagaagaacagaaaatcgggcttttgcgcctgaatattgcggagaaaaagcatggccgggaatgaccgcgagccaattggacgcaaagggaaaccgacgcgtccggtcaaacaaaaggtaagccgtcgtcgttacgaagatgacgatgattacgacgattatgatgactatgaggatgaagaaccgatgccgcgcaaaggtaagggcaaaggcaaagggcgtaagcctcgtggcaaacgcggctggctatggctgctgctaaaactggctatcgtttttgccgtgctgatcgccatttacggcgtttatctcgatcaaaaaattcgtagccgtattgatggcaaggtctggcaattgcccgcggcagtttatggccgaatggtcaaccttgagccagacatgaccatcagcaagaacgagatggtgaagctgctggaggcgacccagtatcgccaggtgtcgaaaatgacccgtcctggcgagtttaccgtacaggccaacagcattgagatgatccgccgtccgtttgatttcccggacagcaaagaagggcaggtgcgcgcgcgtctgacctttgatggcgatcatctggcgacgatcgtcaatatggagaacaaccgtcagttcggtttcttccgtcttgatccgcgcctgatcaccatgatttcttcgccaaacggtgagcagcgtctgtttgtgccgcgcagtggtttcccggatttgctggtggatactttgctggcgacagaagaccgtcatttctacgagcatgatgggatcagtctctactcaatcggacgtgcggtgctggcaaacctgactgccggacgcacggtgcagggggcgagtacgctgacgcaacagttggttaaaaacctgttcctctccagcgagcgttcttactggcgtaaagcgaacgaagcctacatggcgctgatcatggacgcgcgttacagcaaagaccgtattcttgagctgtatatgaacgaggtgtatctcggtcagagcggcgacaacgaaatccgcggcttcccgctggcgagcttgtattactttggtcgcccggtagaagaattgagcctcgatcagcaggcgctgttggtgggtatggtgaaaggggcgtccatctacaacccgtggcgtaacccgaaactggcgctggagcgacgtaacctggtactacgtttgctgcaacagcaacaaattattgatcaagaactctacgacatgctgagtgcgcgtccgctgggtgttcagccgcgcggtggggtgatctctcctcagccagcctttatgcagctggtgcgtcaggagctgcaggcgaaattaggcgataaggtaaaagatctctccggcgtgaagatcttcactacctttgactcggtggcccaggacgcggcagaaaaagccgccgtggaaggcattccggcactgaagaaacagcgtaagttgagcgatcttgaaaccgcgattgtggttgttgaccgctttagcggtgaagttcgtgcgatggtcggtggttctgagccgcagtttgcgggctacaaccgtgcgatgcaggcgcgtcgttcgattggttcccttgcaaaaccagcgacttatctaacggccttaagccagccgaaaatctatcgtttgaatacgtggattgccgatgcgccaatcgcgctgcgtcagccgaatggccaggtctggtcaccgcagaacgatgatcgtcgttatagcgaaagtggcagggtgatgctggtagatgcgttgacccgttcgatgaacgtgccgacggtgaatctgggcatggcgttggggctgcctgcggttacggagacctggattaaactgggtgtgccgaaagatcaactgaatccagttccagcaatgttgttgggggcgttgaacttaacgccaatcgaagtggcgcaggccttccagactatcgccagcggtggtaatcgtgctccgctttccgcgctacgttcagtcatcgcagaagacggcaaggtgttgtatcagagcttcccgcaggcggaacgcgctgttccggcgcaggcggcgtatctgacactatggaccatgcagcaggttgtacaacgcggtacgggacgtcagcttggggcgaaatacccgaacctgcatctggcagggaaaacagggactaccaacaataacgtagatacctggtttgcgggcattgatgggagcacggtgaccatcacctgggtcggccgtgataacaaccagccgaccaaactgtatggtgccagcggggcaatgtcgatttatcagcgttatctggctaaccagacgccaacgccgctgaatcttgttccgccagaagatattgcagatatgggcgtggactacgacggcaactttgtttgcagcggtggtatgcgtgtcttgccggtctggaccagcgatccgcaatcgctgtgccagcagagtgagatgcagcagcaaccgtcaggcaatccgtttgatcagtcttctcagccgcagcaacagccgcaacagcaacctgctcagcaagagcagaaagacagcgacggtgtagccggttggattaaagatatgtttgggagtaattaacgtctaagcgtgatataccggatggcgagctgccatccggtaaaataacatcccctccaaagtattaaccctttcttttcatctgattgtttattgacccttcaggaatgcgcagattgcgtaccgcttgcgaacccgccagcgtttcgaatattatctcatctttgtaataatcattctcgtttacgttatcattcactttacaccagagaaataccaatggcaccttccaaaactgctcagccaaaacactcactgcgtaaaatcgcagttgtagtagccacagcggttagcggcatgtctgtttatgcacaggcagcggttgaaccgaaagaagacactatcaccgttaccgctgcacctgcgccgcaagaaagcgcatgggggccggctgcaactattgcggcgcgacagtcagctaccggcactaaaaccgatacgccgattcaaaaagtacctcaatctatttctgtcgtcaccgctgaagagatggcgctgcatcagcctaagtcggtgaaagaagcgcttagctatacccctggcgttgctgtgggaacccgtggcgcatctaatacttatgattacctgatcatccgcggatttgcggcagacggccaaagccagaataactatctgaatggcctgaagttgcagggcaacttctataacgatgcggtcatcgacccgtatatgctggaacgtgctgaaattatgcgtggcccggtttccgtgctttacggtaaaagcagtcctggcggtctgttgaatatggtcagcaagcgtccgaccactgaaccgttgaaagaagttcagtttaaggccgggactgacagcctgttccagaccggttttgacttcagcgatgcactggatgatgacggcgtttattcttatcgcctgaccggtcttgcgcgttctgccaatgcccagcagaaagggtcagaagagcagcgttatgctattgcaccggcgttcacctggcgtccggacgataaaaccaatttcaccttcctttcttacttccagaacgagccggaaactggttattacggctggctgccgaaagaggggaccgttgagccgctgccaaacggtaagcgtctgccgacagactttaacgaaggggcgaagaacaacacctattctcgtaacgagaagatgattggttatagcttcgaccacgaatttaacgacacctttactgtgcgtcagaacctgcgctttgcgcaaaataaagtttcgcaaaagagcgtatatggctacggtatgtgttcagatccgctgtataccaaagaccaggaggcactcaaggcgagtccatgtttaagtatcccgcagtctcaatggggccatacactgactcgtcagtacgttatcgataatgagaagttagaaaacttctctgttgatactcagttgcaaagcaaattcgcaaccggttctgtggatcacactctgctgactggcgttgactttatgcgtatgcgtaatgacatcgactcctggttcggatatgccggttcagttgcaccatctgatatctataatttagaccgtagtgactttgattttggcgctcacccgaatccgtctggtccataccgcgttctgctgaaacagaaacaaaccggcctgtatgttcaggatcaggcgcagtgggataaagtgctggttacgcttggcggtcgctatgactgggccgatcagtcatctttcaaccgtgattacggtaataaatctgaacgtgacgacaaagagttcacctggcgtggtggtgtaaactacctgttcgacaacggcgtaacgccttacttcagctacagtgaatcatttgaacccgcttcacagactgatgcgaacggtgatctgtttgcaccttcgaaaggcaaacagtatgaagtcggcgtgaaatatgtgccagaagatcgcccaattgtggtgactggcgcactgtatcagcttaccaaaactaataacctgatggcggatccgaacggttcactgttctcggttgaaggcggtgagattcgtgcgcgtggcgtagagctggaagcgaaagcggcactgtcggcgagtgttaacgtagtcggttcttatacttacaccgatgcggaatacactaccgatactacctacaaaggcaatacgcctgcacaggtgccaaaacacatggcttcgctgtgggctgactataccttctttgacggtccgctttcaggtctgacgctgggcaccggtggtcgttatactggctccagctatggtgatccggctaactcctttaaagtgggaagttatacggtcgtggatgcgttagtgcgttatgatctggcgcgagtcggcatggcgggctccaacgtggcgctgcatgtcaacaacctgtttgatcgtgaatacgtcgccagctgctttaacacttatggttgcttctggggcgcagaacgtcaggtcgttgcaaccgcaaccttccgtttctaatttctcttttggggcacggatttccgtgcccgtttcacaagttggctgttatgcaggaatacacgaatcattccgataccacttttgcactgcgtaatatctcctttcgtgtgcccgggcgcacgcttttgcatccgttgtcgttaacctttcctgccgggaaagtgactggtctgattggtcacaacggttctggtaaatccactctgctcaaaatgcttggtcgtcaccagccaccgtcggaaggggagattcttcttgatgcccaaccgctggaaagctggagcagcaaagcgtttgcccgcaaagtggcttatttaccgcagcagcttcctccggcagaagggatgaccgtgcgtgaactggtggcgattggtcgttacccgtggcatggcgcactagggcgctttggtgcggcagatcgcgaaaaggtcgaggaagctatctcgctggttggcttaaaaccgctggcgcatcggctggtcgatagcctttctggcggcgaacgtcagcgggcgtggatcgccatgctggtggcgcaggatagccgctgtctgttgctcgacgaaccgacttcggcgctggatatcgcccaccaggttgatgtactggcgctggtgcatcgtttaagtcaggagcgtggcctgacggtcattgccgtgctgcacgatatcaatatggcggcgcgctactgtgattatctggtcgccctgcgcggcggtgaaatgattgctcagggaacgcctgcggaaattatgcgcggcgaaaccctcgaaatgatttatggcatcccgatgggtattctgccgcatccggcgggtgctgcacctgtgagttttgtttattgatgagcggcttacctcttatttcgcgccgccgactgttaacggcgatggcgctttctccgttcttatggcagatgaataccgcccacgcggcagttattgatcccaatcgtattgtggcactggagtggttgccggtggagttactgctggcgctcggcatcgtgccttacggcgtggcggacaccatcaactatcgcctgtgggtcagcgaaccgccattgccggactcagtgattgacgttggtttgcgtacagaacccaaccttgaactgctgaccgaaatgaaaccgtcgtttatggtctggtctgcaggatatggcccttcaccagaaatgctggcacgtattgcgccggggcgcggatttaacttcagcgacggcaaacagccactggcgatggcgcgtaaatcactgacggaaatggcagatttacttaacctgcaaagcgcagcggaaacgcatttaacgcactatgaagactttatccgcagcatgaaaccccgctttgtgaagcgtggtgcacgcccgttattgctgacgacgcttatcgatccgcgccatatgttggtcttcggtccaaacagcttgttccaggaaattctcgatgagtacggcatcccaaatgcctggcaaggggaaaccaacttctggggcagtaccgccgtcagtatcgatcgtctggcagcgtataaagacgttgatgtgctctgttttgatcacgacaacagcaaagacatggatgcgctaatggcaaccccgctgtggcaggccatgccgtttgttcgcgccggacgctttcagcgcgttccggcggtctggttctatggtgcgacgctttctgcaatgcactttgtgcgtattctggataacgccatcggaggtaaagcgtgagtaaacgaattgcgctttttccggtgttattgctggcgctgctggtggttgctgctgcggcgttgacctggatgaacttctcgcaggcgctgccgcgcagccagtgggcgcaggccgcctggtcgccggatattgacgtcatcgagcagatgatttttcactacagcttgttgccgcgtctggcgatttcgctgctggtgggcgcgggcctggggctggtgggcgtgctgtttcagcaagtgctgcgtaacccgctggcggaaccgacgacattgggtgttgcaacaggcgcgcaactggggattaccgtcaccacgctctgggcaatccccggcgcgatggcgagccagtttgctgcgctggcaggggcttgtgttgttggcttaatcgtctttggcgtcgcgtgggggaaacgtctttcgccggtaacgctgatcctcgcggggctggtagtgagcctttattgcggcgcaatcaatcagttactggttatcttccatcatgaccaactgcaaagcatgttcctgtggagcaccggaacgctgacgcaaaccgactggggcggcgttgaacgtttatggccgcagctgctgggcggcgtgatgctgacgttattgctacttcgcccgttaactctgatggggcttgatgatggcgtggcgcgcaatctcgggctggccttgtcgctcgctcgtctggcggcgttgtcgctggcgattgtcatcagtgcgctgctggtgaacgcggtggggattatcggctttatcgggttgttcgcgccactgctggcgaaaatgctggggacgcggcgtttgttgccacggttgatgctggcatcgctgattggtgcgttaattctgtggctttctgatcaaatcatcctctggctgactcgcgtgtggatggaagtgtccaccggttcggtcactgcgttgatcggtgcgccgctgctactgtggttgctgccgcgtttacgcagcattagcgcgccggatatgaaggtcaacgatcgtgtcgcgactgaacgccaacacgtgctggcgtttgccctcgcgggcggcgtgctgctgttgatggctgtggtggtggcgctgtcgtttggtcgtgatgcgcacggctggacgtgggcgagcggggcgttgctcgaggatttgatgccctggcgctggccgcgaattatggctgcgctgtttgcgggcgtcatgctggcggtggcgggctgtattattcagcggctgaccggaaacccgatggcaagcccggaagtgctggggattagctccggcgcggcgtttggcgtggtgttaatgctgtttctggtgccgggtaatgcctttggctggctgttacccgcaggcagtctcggggcggcggtgacgctgttgatcattatgatcgccgccggacgcggtggattttccccacaccgcatgttactggcggggatggcgttaagtaccgcgttcaccatgcttttgatgatgttgcaggcaagtggtgacccgcgaatggcgcaagttctgacctggatttccggttcgacctacaacgcgaccgatgcgcaggtctggcgtaccggaattgtgatggtgattttgctggcgattaccccgctgtgccgccgctggctgaccattttaccgctgggtggtgataccgcacgagccgtggggatggcgctgacgccgacgcgaattgcgctgctgctgttagcggcttgcctgacggcgactgcgacaatgaccattggaccgttgagttttgttggtttaatggcaccgcatattgcgcggatgatgggctttcgacggacgatgccacacatcgtaatttcggcgctggtgggtggtttactgctggtgttcgctgactggtgtgggcggatggtgctgtttccattccagatccccgcggggctgctgtcgacctttatcggcgcgccatattttatctatttgttgagaaagcagagccgttaattgaatgcctcgcccggtgggcgaggcaaaatcatcacaacttcgcaaacacccgacgtgcagcatcgatggtgttattgatatcttccatgctgtgcgccacagacataaagtccgcttcaaacgctgacggtgccagataaacaccttcgtccagcatcatatggaagaaacgcttaaagcgttccacgtcacaggccatcacatcctgatagcacgtcacggactcggcgtcggtaaagaaaataccgaacatgccgccaacgtggtttaccaccagcggaattccggcttcttctgccgcttcccgcagaccttctgccagacgtgttgtcagctcatccagcgtctcgtgaacgcccggctgtgcgacttcattcagacaggcgaaaccagcagccatcgcaatcgggttaccggaaagcgtacccgcctgatagaccggaccggtcggggccagcgcatccattacatcacgacgaccaccgaatgcgcctaccggcattccaccgccgatgattttgccgaggcaggtgagatccggttccacaccgtaataatcctgtgcgccagctagcgctacgcggaaaccggtcatcacttcatcgatgatcagcaacgcgccaaattcgtcgcacagcgcgcgcagacctggcaggaactctggcagcggtggaacgcagttcatattgcctgccaccggctcgacgataatacaggcaatctcttgcgggtattgctcaaacgcggcgcgtacagaggccagatcgttataagtacaggttaaggtatgtttggcgaaatctgccggaacgcccggcgaatttggctggcctaacgtgagtgcgccagaaccggctttcaccagcaggcagtcagcgtgaccgtggtaacaaccttcaaatttaataattttgtcgcgaccggtaaaaccacgggccaggcggatggcgctcatcgtcgcttcagtgccggagttcaccatgcgcaccatatccatggtcgggaccagttcggtcaccagttgcgccattttcacttccatttcggttggtgcaccaaagcttaaaccacgctcggcggcttcaatcacggcattgcggatcgccggatggttatggcccagcaccatcggcccccaggaaccgacataatcgatataggctttgccatcaacatcgtacagataagcgccgtccgctttttcgataaacagtggagtgccgcccacgccagtaaaggcgcgaacaggggagttcacaccgccagggatcagctcgcgcgctgcgctgtaaagattttcagacttactcatggagggttcctgattcgtagaaaaagtgaatggctgctattctatgttattcataacaagttaaatactcgtcaaacatcaggctgcttgtactggtgcaatcctgatttcttagagtataaaagttttgtgcatttgaaacattacgctttgcaaaggattttcatggaacgtgcgagtaaaatgccgtcatcttatttgtatgaccaataagtgatcattggatgaaaactgatactccctctttagaaacaccgcaggccgcgcgcctgcgacgcagacaactgattcgccaacttcttgagcgcgataaaaccccgttagccattttgtttatggcggcagtcgtcggcacgcttgtcgggctggctgcggttgcttttgacaaaggtgtcgcctggttgcagaaccaacgtatgggggcactggtacatactgctgataattatccgcttctgttaaccgtcgcttttctctgttcggcggtgctggcgatgttcggctactttttggtgcgcaaatacgcgccggaagcaggtggttcggggatcccggaaattgaaggggcgctggaagatcaacgtcccgttcgctggtggcgtgtgttgccggtgaaattctttggcgggctggggacactcggcggaggcatggtgttggggcgcgaagggccaaccgtgcagataggcggcaatatcgggcggatggtactcgatgttttccgcctgaaaggtgacgaagctcgtcatacgctgttggcaaccggtgctgctgcggggctggctgcggcctttaacgcgccgctggcgggtattttgtttattatcgaagagatgcgtccgcagtttcgctatacgttaatttcgattaaagcggtatttattggcgtcattatgtcgaccattatgtaccggatttttaatcatgaagttgcgttgattgacgtcggtaaactttctgatgcgccgcttaatacgctgtggctttatctgatcctcggtattatttttggcattttcggccctatttttaataaatgggtgctggggatgcaggatttgctgcaccgtgtgcacggtggcaatattaccaaatgggtactgatggggggtgcgattggcggtctgtgtggattgctggggtttgtggcaccagcaacttcgggcggcggttttaacctgattcctatcgctacagcggggaatttcagcatgggaatgctggtgtttatcttcgtcgcgcgggtcattaccaccttactctgcttctcttccggcgcgccgggcggtatttttgccccgatgctggcgctgggtactgtgctgggaaccgctttcggaatggttgccgttgagttgtttccgcaatatcaccttgaggcggggacgtttgctattgccggaatgggggcgttactggcggcatctattcgcgcgccgttaacggggatcattctggttctggaaatgaccgataactaccagctcattttgccaatgattattaccggtcttggcgcaacactattagcacaatttaccggtgggaaaccgctatactcggcgattcttgcgcgcacgctggcaaaacaggaagctgagcaactggcgcgaagcaaggccgcatcagccagcgagaatacttgaacgaaataccagggtattagataatggcgattattattgggttagaatttgcccaattgccgatgtcgtttggagcaaaatatgagtgatgacgtagcactgccgctggagtttaccgacgcagcagccaacaaagttaaaagcctgatcgctgacgaagataacccgaatctgaaattacgcgtgtatatcaccggtggcggttgcagcggcttccagtatggtttcacctttgatgatcaggtgaacgaaggcgatatgaccatcgaaaaacagggcgttggcctggtggttgatccgatgagcctgcaatatctggttggcggttccgttgactataccgaaggtctggaaggttctcgtttcatcgtgaccaacccgaacgcgaaaagtacctgcggttgcggttcttcctttagtatctaatctgctgttcatgtgccggataaactatccggcacatcttctctcttcaacgaccattctcatccagcgcaaacgtcggtagcttaagatgccaacgaatagccgccagccgaatcaatagcgtcacgaccatgcccatcatactggctgtttccagtggtacggaaaatgtgtaataagccgtagcgtggacaataccgccgataatacaggcagttgcgtagatttctgtacgtaaaatcatggggatttcgcgggccagtacatcacgaatgatcccgccgccaacgccagtaatgacgcccatacaaaccgcgattaacggaccggcttccgcattaaaggctttattcacgccaatgccgacaaacaccgccagaccaacggcgtccagcaccggcaacatccattttggtaagcgtcttggctggcgcaccagcacgatggtcagcatgctggtgaccattgcaacgaccagatcggtgggatctttcacccaaaataccgggccgtgatccagcgccatgtcgcgaattgttccgccgcctactgcggtaaccacgcccaataccagaaaaccaaaagggtccatacgcaattttccggctaacaaaacgccagagatagcaaataccgctgtgccgactatatccagccaatagacgagcattgttcaatccccactgagcacctgaaaaggtcaggcactaatctacctgtgaaagcgcattacagagctgttgtgcagcgaggataatacgtgggcttgcacgttcaaaccagtcactcgtgagaggaataacgggaattttgagctgttcaccccagtattgtttgattttaggaatttggtccggtccgcctgtcatgacaatcgcctgtggcgagcgtgctaacacctgttcgcggctaacttgcggccagggaacccggctgtctttaaagatgttttctccgccacaaacttcgagtacctggttctgaatcgactcttttccactggtaaatggcggattaatgccgaattgcagaaaaacacgttttttaggtttatcagcatattgcgctttcaattgcgcgtactgatccagcagggattgcgcggcttgttcggccttatccggttgcggactccagggggccagttgacgtaacgcattggcaatttgttcaatgcttgtcgcatcgacccacatcacttttattcccagcgaagccagctggtcaacctgccgctcggcattacctccacgccaggcaatcaccagatcgggtttcagcgcgacaatgcgttccagattcatcccctgccaggtggaaacctgctcaatcttttgcgcttgtggaggatagtcggaatagctgctgaccccaaccggcgtgatcccggcggcaaaggcaagttcagtgttggcgggagaaagcgtgatgacgcgcggcgcggcattgagccacagcggcgcgagaaaagacagggcgaccagcgccctgaacagtgacttagccatgtgccagtttctgcaccagtgactcaaccatcaggctggactgtttagcggcaacagccaggaactcatcgaagctaagatgagactgttgatcggccacgtcggaaatggcgcgtactacgacaaacgggacgttgaaattgtggcagacatgggcgattgccgtcgcttccatctctacagcaatggcctgtgggaagttgtggcggattttcgccagaccaacagaaccgttgatgaaagcgtcgccgctaacaatcaggccacgtacagcgttaagattcagttcggcaatgcaggcctcagcggcagcgatcagtttatcgtcagctttgaagcctgccgggcagcctggtaactgaccgtattcataaccaaatgccgtgacatccgcgtcgtgataacgcgcttcgtccgagacaacgatatcgcccactttcagcgttggtgccaggccaccggcagaaccggtgttaataatcacatctggcttgcagtgttccaacagcagagtggcacccagcgccgcagcgactttaccgatgcccgatttcagaagcgcaacctcggttccattcagttggccggtatagatttcgcaaccgcccagactgatagtttgacggttttcgattttgtcacgcagcagcgtaacttcttcttccattgcaccaatgatgccgattttcatagatttactcgcgataagcccgatttgaaggcatagtttaccatgcgcttacggggaagcgtatttctcacgcgggagaggacatggcacagattgatttccgaaaaaaaataaactggcatcgtcgttaccgttcaccgcagggcgttaaaaccgaacatgagattctgcggatcttcgagagcgatcgcgggcgtatcatcaactctccggcaattcgtcgtctgcaacaaaagacccaggtttttccactggagcgcaatgccgccgtgcgcacgcgtcttacccactcgatggaagtccagcaggtggggcgctacatcgccaaagaaattttaagccgtctgaaagagcttaaattactggaggcgtatggtctcgatgaactgaccgggccctttgaaagcattgttgagatgtcatgcctgatgcacgatatcggcaatccgccgtttggtcattttggcgaagcggcgataaatgactggtttcgccagcgtttgtacccggaagatgccgaaagccagcctctgactgacgatcgctgcagcgtggcggcactacgtttacgggacggggaagaaccgcttaacgcgctgcggcgcaagattcgtcaggacttatgtcattttgaaggtaacgcacagggtattcgtttggtgcatacattgatgcggatgaatctcacctgggcacaggttggcggtattttaaaatatacccgtccggcgtggtggcgtggcgaaacgcctgagacacatcactatttaatgaaaaagccgggttattatctttctgaagaagcctatattgcccggttgcgtaaagaacttaatttggcgctttacagtcgttttccgttaacgtggattatggaagctgccgacgacatctcctattgtgtggcagaccttgaagatgcggtagagaaaaggatatttaccgttgagcagctttatcatcatttgcacgaggcgtggggccagcatgagaaaggttcgctcttttcgctggtggttgaaaatgcctgggaaaaatcacgctcaaatagtttaagccgcagtacggaagatcagttttttatgtatttacgggtaaacaccctaaataaactggtaccctacgcggcacaacgatttattgataatctgcctgcgattttcgccggaacgtttaatcatgcattattggaagatgccagcgaatgcagcgatcttcttaagctatataaaaatgtcgctgtaaaacatgtgtttagccatccagatgtcgagcagcttgaattgcagggctatcgggtcattagcggattattagagatttatcgtcctttattaaacctgccgttatcagactttactgaactggtagaaaaagaacgggtgaaacgtttccctattgaaacgcgcttattccacaaactctcgacgcgccatcggctggcctatgtcgaggctgtcagtaaattaccgtcagattctcctgagtttccgctatgggaatattattaccgttgccgcctgctgcaggattatatcagcggtatgaccgacctctatgcgtgggatgaataccgacgtctgatggccgtagaacaataaccaggcttttgtaaagacgaacaataaatttttaccttttgcagaaactttagttcggaacttcgcgctataaaacgaatctgaagaacacagcaattttgcgttatctgttaatcgagactgaaatacatgaaaaaaaccacattagcactgagtgcactggctctgagtttaggtttggcgttatctccgctctctgcaacggcggctgagacttcttcagcaacgacagcccagcagatgccaagccttgcaccgatgctcgaaaaggtgatgccttcagtggtcagcattaacgtagaaggtagcacaaccgttaatacgccgcgtatgccgcgtaatttccagcagttcttcggtgatgattctccgttctgccaggagggttctccgttccagagctctccgttctgccaggggggcctgggcggtaatggcggcggccagcaacagaaattcatggcgctgggttccggcgttatcattgatgccgataaaggctatgtcgtcaccaacaaccacgttgttgataacgcgacggtgattaaagtccaactgagcgatggtcgtaagttcgacgcgaagatggttggcaaagatccgcgctctgatatcgcgctgatccagatccagaacccgaaaaatctgaccgcaattaagatggcggattctgatgcgctgcgcgtgggtgattacaccgtagcaattggtaacccgttcggcctgggcgagacagtaacttccgggattgtctctgcgctgggacgtagcggcctgaacgctgaaaactacgaaaacttcatccagaccgatgcagcgatcaaccggggtaactcaggtggtgcgttggttaacctgaacggcgaactgatcggtatcaacaccgcgatcctcgcaccggacggcggaaacatcggtatcggttttgctatcccgagcaacatggtgaaaaacctgacctcgcagatggtggaatacggccaggtgaaacgtggtgagttgggtattatgggcactgagctgaactccgatctggcgaaagcgatgaaagttgacgcccagcgcggtgctttcgtaagccaggttctgccgaattcttccgccgcgaaagcgggcattaaagcgggtgatgtgatcacctcactgaacggtaagccaatcagcagctttgccgcactgcgtgctcaggtgggcactatgccggtaggtagcaaactgaccctgggcttactgcgcgacgggaagcaggttaatgtgaacctggaacttcagcagagcagccagaatcaggttgattccagcaccatcttcaacggcattgaaggcgctgagatgagcaacaaaggtaaagatcagggcgtggtggtgaacaacgtgaaaacgggcactccggctgcgcagatcggcctgaagaaaggtgatgtgattattggcgcgaaccagcaggcagtgaaaaacatcgctgaactgcgtaaagttctcgacagcaaaccgtctgtgctggcactgaacattcagcgcggcgacagcaccatctacctgttaatgcagtaatctccctcaaccccttcctgaaaacgggaaggggttctccttacaatctgtgaacttcaccacaactccatacatcttcatcatcctttgggcatttgcacaatgccgtacgttacgtacttccttatgctaagccgtgcataatggaggacttatggctggctggcatcttgataccaaaatggcgcaggatatcgtggcacgtaccatgcgcatcatcgataccaatatcaacgtaatggatgcccgcgggcgaattatcggcagcggcgatcgtgagcgtattggtgaattgcacgaaggagcattgctggtactttcacaaggacgagtcgtcgatatcgatgacgcggtggcacgtcatctgcacggtgtgcggcaggggattaatctaccgttacggctggaaggtgaaattgtcggcgtaattggcctgacaggtgaaccagagaatctgcgtaaatatggcgaactggtctgcatgacggctgaaatgatgctggaacagtcgcggttgatgcacctgttggcgcaggatagccgtttgcgggaagaactggtgatgaacctcattcaggctgaggagaatactcccgcacttactgaatgggcgcaacggctggggatcgatctcaatcaaccgcgagtggtggctattgttgaggtcgacagcggtcagcttggcgtggacagcgcaatggcggagttacagcaactgcaaaatgcgctgactacgcccgagcgtaataatctggtggcgattgtctcgctaaccgaaatggtggtgttgaaaccggcgttgaactcttttgggcgctgggacgcagaagatcatcgtaagcgagttgaacaactgattacccgcatgaaagagtatggccagttgcgttttcgcgtttcgctgggcaactattttaccggtcctggcagtattgcccgatcctatcgtacggcgaaaacgacgatggtggtggggaaacagcggatgccagaaagtcgctgctatttttatcaggatctgatgttacctgtgttactcgacagtttgcgtggcgactggcaggccaacgaactggcgcgaccgctggcgcggctgaaagcgatggacaataacggcttgctgcggcgaacgctggcggcgtggtttcgccacaatgtgcaaccgctggcaacgtcaaaggcgttgtttattcatcgtaatactctggaatatcggcttaatcgtatatcggaactgaccgggcttgatttgggcaattttgatgacaggttgctgctgtatgtggcgttacaactggatgaagagcggtaggtcgattacaaaattacagccgggtgagactttacccggcccacagaatggcattatttacgcgtcagtttttccagatcggcttcaatctcgctgatcttattggttactactgactccaggtgacgtaagtcgtcgaggatcttacgcttaagatcaacttcgctgcggtcacgctggcagatttgatcaagctcatcaatgatataccgtagattcgggctaatttcctggacttctttataaccctgacccacaccatcagcgacgaccgttttacgctgacgcgggtatttaaacttcacgctcttggcgaaaaactcgcctttgtctttctggaaatagattttcagaatatcgttgttggcttcctgccggaggctgtaacgatcaatttcttcaggattggtaatacccagacttttcagattgtcgtacatagcgttacctcaaaatgagtcagtaaattgtgcttattttagcatttggcctggcccgcccggctcgactgtgatcgcagaaagcctttttcttccagacttctatcatggcgtaaaaatcaaaaaattacctgctttattgtggtgatattctatgggatggattagcacatttatcttcattttgcgaattacatgacagtccgaaacaagatgaaaaagtatttaaaaaaaagggggaaaatgagtaggacgaattattctgagccagaaagcaatcgggcagcgtcgtgctgcccgtgtacatacttttagtcgatggtacgcagcagttcgttaataccaactttgccgcgagttttcgcgtcaactttcttaacgataactgcacagtagaggctgtatttgccatctttcgacggcagattacctgaaacaaccacagaccctgccggaacgcgaccgtagtggatttcgccggtttcacggtcataaatacgggtgctctgaccaatgtatacgcccatagagatgacggaaccttcttcgacaatcaccccttcaaccacttcagagcgtgcgccgatgaagcagttatcttcaataatggtcgggttagcctgcagcggctccagcacgccgccgatacccacgccaccggaaaggtggacgtttttaccaatctgcgcacaggaaccgacggtcgcccaggtatcaaccatggtgccttcatcaacatatgcgccgatgttgacgtaagacggcatcagcacggtgttacgggcaatgaacgcgccctgacgcactgccgctggtggcacgacgcggaagccttctttctggaaaagtgcttcatcgtagttagcgaatttcatcggcactttgtcgaagtagcggctttctgccccttcgatcacctgattatcattaatacggaaagagagcagcaccgattttttcaaccactgatgcgtcacccactgaccgtcaattttttccgctacacgcagtgcgccggaatccagcagggcgatcacctgatttaccgcttcgcgggtaacggtgtctgcattggctggcgtgatctcggcacggcgttcaaaagcggtttcaataatgttctgtaactgctgcattgttaaactcttttcatatcagtaaacacatcaccctttatcgtttggattgagggcctctgtcaaccgctgatgcacttcctgctgcaactcgttattaagcgcacgccggtcagcggtggcaattatgaataaatcttctactcgctcgccaatggttgtaattcgggcgccatgaagcgaaattcccagatcggcaaaaattttcccgactcgcgccagcagtccaggttggtcgagggcgatcagttcgaggaacgatttgcggtcggtatgggtcggcaaaaacgtcacttcggtttcaacagtaaaatggcgcaatttagcgggttggcgacggggctgcggtggctgccagctactttgtgtcagtacttgctccagaccaaaccgaataacctcatgacgatctgcggatagcgggctaccatcgggttccagcactataaaggtatccatcgccataccgtcgcgagtggtgaaaatttgtgcgtcgtgaacacttaaattgcggcggtctaattcggcacagacggcggcaaacagataggggcggtccgggctccagataaaaatctcggtgcctccacgcgtagcctgcgggctaagcagtaccagcggtttgcctaaatcatgctgtaataaatggcgtgcgtgccaggccagttgatttgggctatggcggacaaaatagttagcgcgacagcgtgaccaaatttggtgcagcgcctcttcgtcgatgttatccatgcgcagtagtgccagcgcctggagttggtgatggcgaacccgttcgcgcatatccggcgtgttttgcattccgcgtcgtagctgcttttcggtggcaaaatagagttcgcgcaacagactttgcttccagctattccacagtgtttcgttggtggcgcaaatgtcagccactgtcaggcataccagatagcgcagacgattttccgtttgaacttcttcggcaaactgcttgatgacttccgggtcctgaatatcgcggcgctgagcggtcaccgacatcagcaagtgctggcgaaccagccaggcgaccagctgtgtttcgcgtgagttcagcccgtggagttcggcaaaatgcactacatcctgagcaccgagaatggagtggtcgccgccgcgtcctttggcgatatcgtgaaacagcgcggcgatgaaaatcagctcagttgacggcaggcgcggccagacgtccacacacaacggatggcgctggcgcgtttcttcactggcaaaactctctagtttcaacatcacgcggatagtatgttcatccaccgtgtaggcgtggaacagatcaaactgcatctgcccgacgatatgcgaccattgcggcatatacgcgccgagtacgctatggcgatgcattggcaatagcccgcgccgcaccgctccggggtgacgaagaatgctcaaaaacagttttcgcgcttccggaatattacacagaggttgttgcagatggcgacgggcgtggcgtaactggcgtagcgtggtggagtaaatgccggtgatcgcactgttgcgcaccatggtgtagaacatacgcaagatggcttccggctggcgcataaatagtgtttcatcacgcaggtcgatcagcgttccgcgtagctgaaactcatcgtcgattggacgtggtttttcgtcggcgggaagggcgaggatggcttcatcgaacagttgcagcagcatctggttgagttcactgacgcggcgtgtaacgcggaagtaatccttcatcatccgctcgaccggttcgttaccttcaccactgtaattcaaacgctgggcgacgctaagctggcgatcgaataacaggcgattatcgtaacgactgatgaccagatgcagggcaaagcgaatgcgccacaatatatgcaggcattcgtttaattccgctctctccgcagaggttaagaagccaaaccctaccatttcatccagcgatgttgcgccaaaatgacggcgggccacccattgcagagtgtggatatcgcgcaagccgccggggctacttttgatgtctggttcaaggttgtagctggtgccgtggtaacgctgatggcgctggttctgttcttcaactttcgccgcgtagaacttgtcggaaggccagaatccttcgctaaaaatatgtttttgcagttcgaggaacagcgcaacatcgccaattaataagcgggattcgattaaattggtggcgacggttaaatccgataacccttccagcatgcactcttcaagcgtgcgcacgctatgacctacttccagctttacatcccagagcagcgttaacagctcgcccactttttgcgcctgatcgtccgggagctttttacggcttaaaatcagtaaatcgatgtcagaaagtggatgcagctcgccacgaccgtagccaccgacggcgaccaatgccaggtcggcaatctggctgaatcccgcttcaatccataatcgttgaagaagctggtcgataaactcggtacgcgcctcaatcaactgttctgcggagataccattgtcaaaggcatcacccagccaacgctggaaagtatcgatatgggcttttatcccaccgacggttaattcatcacggggccaggcgcatggattttgcggttgaccgtgcagggtggggagagcggtgtttgcgtactgttctggaagggtattcattgtgcgccacccataagattaaattattgcattaaaaaagccggcattcgccggcttcattttattcgtcgtgcgagattatcgccgggatggtgtcatccttgcgtagcgtcagaatttcgcagccgttatcagtcaccacaatagtatgctcatattgtgcagacaagctgcgatctttggtttttaccgtccagccatctttcatggtgcggatctcttttttacccgcgttgaccattggctcgatggtgaacgtcatccccggtttcagcacgacgttggtttcacgggagtcatagtgcagcacctgcggttcttcgtggaagccgcgaccaataccgtgtccacaatattcacgaacgacggagaagccttctgcttcgacaaatttctgaattgccgcaccgatttcgcgcagattaatgctaggttttaccatgcgtagcgccaggtacaggctttcttgcgtgatgcggcacagacgttcgcccatgatggtcggcttaccgacgataaacattttcgaggtatcgccgtggaaaccatctttgattacggtgacatcaatgttaacgatatcgccatctttcagcagcttggcgtcgtccgggataccgtggcacaccacttcattaatagagatgcaaacggatttcggatagccgtgatagccgaggcaggcagaaaccgcgtgttgttcattaacaatgtaatcattacagatgcgatccaactcgccggtgctgacgcccggtttaacatatggttcgatcatctccagcacttcggcagccagtcggccagcgacgcgcattttttcgatatcttctggggtcttgattgagatagccattaattctgtccatcagcgtcggtgataccgacaatatatatgtaagtgccgtcaatggtatcacacccgggcaaattgagaatcattctgaatttcgccaaacgtgccactgaaggttttctataatagaaaattcaacgtctgatgctgtacacagcgccaacaattattggtgtccacgacgtatttgtggtataaagcgcgccggacttccgatccatttcgtatacacagactggacggaagcgacaatctcactttgtgtaacaacacacacgtatcggcacatattccggggtgccctttggggtcggtaatatgggatacgtggaggcataaccccaacttttatatagaggttttaatcatggcaactgtttccatgcgcgacatgctcaaggctggtgttcacttcggtcaccagacccgttactggaacccgaaaatgaagccgttcatcttcggtgcgcgtaacaaagttcacatcatcaaccttgagaaaactgtaccgatgttcaacgaagctctggctgaactgaacaagattgcttctcgcaaaggtaaaatccttttcgttggtactaaacgcgctgcaagcgaagcggtgaaagacgctgctctgagctgcgaccagttcttcgtgaaccatcgctggctgggcggtatgctgactaactggaaaaccgttcgtcagtccatcaaacgtctgaaagacctggaaactcagtctcaggacggtactttcgacaagctgaccaagaaagaagcgctgatgcgcactcgtgagctggagaaactggaaaacagcctgggcggtatcaaagacatgggcggtctgccggacgctctgtttgtaatcgatgctgaccacgaacacattgctatcaaagaagcaaacaacctgggtattccagtatttgctatcgttgataccaactctgatccggacggtgttgacttcgttatcccgggtaacgacgacgcaatccgtgctgtgaccctgtacctgggcgctgttgctgcaaccgtacgtgaaggccgttctcaggatctggcttcccaggcggaagaaagcttcgtagaagctgagtaataaggcacgctcgtacgagcccttatagaccaggtagtacacgtttggttagggggcctgcatatggccccctttttcacttttatatctgtgcggtttaatgccgggcagatcacatctccgaggattttagaatggctgaaattaccgcatccctggtaaaagagctgcgtgagcgtactggcgcaggcatgatggattgcaaaaaagcactgactgaagctaacggcgacatcgagctggcaatcgaaaacatgcgtaagtccggtgctattaaagcagcgaaaaaagcaggcaacgttgctgctgatggcgtgatcaaaaccaaaatcgacggcaactacggcatcattctggaagttaactgccagactgacttcgttgcaaaagacgctggtttccaggcgttcgcagacaaagttctggacgcagctgttgctggcaaaatcactgacgttgaagtactgaaagcacagttcgaagaagaacgtgttgcgctggtagcgaaaattggtgaaaacatcaacattcgccgcgttgctgcgctggaaggcgacgttctgggttcttatcagcacggtgcgcgtatcggtgttctggttgctgctaaaggcgctgacgaagagttggttaaacacatcgctatgcacgttgctgcaagcaagccagaattcatcaaaccagaagacgtatccgctgaagtggtagaaaaagaataccaggtacagctggatatcgcgatgcagtctggtaagccgaaagaaatcgcagagaaaatggttgaaggccgcatgaagaaattcaccggcgaagtttctctgaccggtcagccgttcgttatggaaccaagcaaaactgttggtcagctgctgaaagagcataacgctgaagtgactggcttcatccgcttcgaagtgggtgaaggcatcgagaaagttgagactgactttgcagcagaagttgctgcgatgtccaagcagtcttaattatcgaaaaggagccgcctgagggcggcttctttttgtgcccatcttgtaaattcagctaacccttgtggggctgcgctgaaaagcgacgtacaatgtcgctagtattaattcatttcaatcgttgacagtctcaggaaagaaacatggctaccaatgcaaaacccgtctataaacgcattctgcttaagttgagtggcgaagctctgcagggcactgaaggcttcggtattgatgcaagcatactggatcgcatggctcaggaaatcaaagaactggttgaactgggtattcaggttggtgtggtgattggtgggggtaacctgttccgtggcgctggtctggcgaaagcgggtatgaaccgcgttgtgggcgaccacatggggatgctggcgaccgtaatgaacggcctggcaatgcgtgatgcactgcaccgcgcctatgtgaacgctcgtctgatgtccgctattccattgaatggcgtgtgcgacagctacagctgggcagaagctatcagcctgttgcgcaacaaccgtgtggtgatcctctccgccggtacaggtaacccgttctttaccaccgactcagcagcttgcctgcgtggtatcgaaattgaagccgatgtggtgctgaaagcaaccaaagttgacggcgtgtttactgctgatccggcgaaagatccaaccgcaaccatgtacgagcaactgacttacagcgaagtgctggaaaaagagctgaaagtcatggacctggcggccttcacgcttgctcgtgaccataaattaccgattcgtgttttcaacatgaacaaaccgggtgcgctgcgccgtgtggtaatgggtgaaaaagaagggactttaatcacggaataattcccgtgatggataaataagggtaagattccgcgtaagtatcgcgggggatcttacccgtaatatgtttaatcagggctatacttagcacacttccactgtgtgtgactgtctggtctgactgagacaagttttcaaggattcgtaacgtgattagcgatatcagaaaagatgctgaagtacgcatggataaatgcgtagaagcgttcaaaacccaaatcagcaaaatacgcacgggtcgtgcttctcccagcctgctggatggcattgtcgtggaatattacggcacgccgacgccgctgcgtcagctggcaagcgtaacggtagaagattcccgtactctgaaaatcaacgtgtttgatcgttcaatgtctccggccgttgaaaaagcgattatggcgtccgatcttggcctgaacccgaactctgcgggtagcgacatccgtgttccgctgccgccgctgacggaagaacgtcgtaaagatctgaccaaaatcgttcgtggtgaagcagaacaagcgcgtgttgcagtacgtaatgtgcgtcgtgacgcgaacgacaaagtgaaagcactgttgaaagataaagagatcagcgaagacgacgatcgccgttctcaggacgatgtacagaaactgactgatgctgcaatcaagaaaattgaagcggcgctggcagacaaagaagcagaactgatgcagttctgatttcttgaacgacaaaaacgccgctcagtagatccttgcggatcggctggcggcgttttgctttttattctgtctcaactctggatgtttcatgaagcaactcaccattctgggctcgaccggctcgattggttgcagcacgctggacgtggtgcgccataatcccgaacacttccgcgtagttgcgctggtggcaggcaaaaatgtcactcgcatggtagaacagtgcctggaattctctccccgctatgccgtaatggacgatgaagcgagtgcgaaacttcttaaaatgatgctacagcaacaggggagccgcaccgaagtcttaagtgggcaacaagccgcttgcgatatggctgcgcttgaggatgttgatcaggtgatggcagccattgttggcgctgctgggctgttacctacgcttgctgcgatccgcgcgggtaaaaccattttgctggccaataaagaatcactggttacctgcggacgtctgtttatggacgccgtaaagcagagcaaagcgcaattgttaccggtcgatagcgaacataacgctatttttcagagtttaccgcaacctatccagcataatctgggatacgctgaccttgagcaaaatggcgtggtgtccattttacttaccgggtctggtggccctttccgtgagacgccattgcgcgatttggcaacaatgacgcccgatcaagcctgccgtcatccgaactggtcgatgggacgtaaaatttccgtcgattcggctaccatgatgaacaaaggtctggaatacattgaagcgcgttggctgtttaacgccagcgccagccagatggaagtgctgattcacccgcagtcagtgattcactcaatggtgcgctaccaggacggcagtgttctggcgcagctgggtgaaccggatatgcgtacgccaattgctcacaccatggcatggccgaatcgcgtgaactctggcgtgaagccgctcgatttttgcaaactaagtgcgttgacatttgccgcaccggattatgatcgttatccatgtctgaaactggcgatggaggcgtttgaacaaggccaggcagcgacgacagcattgaatgccgcaaatgaaatcaccgtggctgcttttcttgcgcaacaaatccgctttacggatatcgctgcgttgaatttatccgtactggaaaaaatggatatgcgcgaaccacaatgtgtggatgatgtgttatctgttgatgcgaacgcgcgtgaagtcgccagaaaagaggtgatgcgtctcgcaagctgaggataatccggctacagagagtcgcgctatttgttagcgtagggcttcagtgatatagtctgcgccatctgatcgtaagtagttggctttataaggtcaggtatgccgtggttttacacggcttttttttgtataggcttcagtattcctgagtaccgtaaaccctgtcagggaataagaaacgcgtgatgttgtctgctactcaaccacttagcgaaaaattgccagcgcatggctgtcgtcatgttgcgatcattatggacggcaatggtcgctgggcaaaaaagcaagggaagattcgtgcctttgggcataaagccggggcaaaatccgtccgccgggctgtctcttttgcggccaacaacggtattgaggcgttaacgctgtatgcctttagtagtgaaaactggaaccgaccagcgcaggaagtcagtgcgttaatggaactgtttgtgtgggcgctagatagcgaagtaaaaagtctgcaccgacataacgtgcgtctgcgtattattggcgataccagtcgctttaactcgcgtttgcaagaacgtattcgtaaatctgaagcgctaacagccgggaataccggtctgacgctgaatattgcggcgaactacggtggacgttgggatatagtccagggagtcaggcaactggctgaaaaggtgcagcaaggaaacctgcaaccagatcagatagatgaagagatgctaaaccagcatgtctgtatgcatgaactggcccctgtagatttagtaattaggactgggggggagcatcgcattagtaactttttgctttggcaaattgcctatgccgaactttactttacagatgttctctggcccgatttcgatgaacaagactttgaaggggcgttaaatgcctttgctaatcgagagcgtcgtttcggcggcaccgagcccggtgatgaaacagcctgatgggggtcgcttttgctgaagtatcgcctgatatctgcttttgtgttaatacccgtcgtcatcgcggcgttgtttctgttgccgccggtggggttcgccattgtaacgctggtggtctgtatgctggcagcgtgggaatggggacagcttagcggttttaccactcgttcgcagcgagtatggttggcggtgttatgcgggttattgttggcgctgatgctttttctgttgccggaatatcaccgaaatattcatcaaccgctggttgaaatctcactttgggcttcgctgggttggtggattgtcgcgctattgctggtgctgttttacccaggttccgcagcaatctggcgtaactctaaaacattgcgcattatttttggcgtgctaaccattgttcccttcttctggggcatgctggcgttacgggcctggcactacgacgagaatcattacagtggcgcaatatggctgctctatgtcatgatcctggtatggggcgctgactctggcgcatatatgtttggcaaattgtttggtaaacataaactggcaccgaaggtttctccgggtaaaacctggcaaggctttatcggtggactcgcgaccgcagcggtaatctcatggggttatggcatgtgggtgaatctcgacgtcgctcccgtcaccttactcatttgctctattgtcgcagcgttagcctcagtgctcggcgatctgaccgaaagtatgtttaagcgtgaagcaggaattaaggacagcggtcatttaattccaggacacggtggtattttagatcgtattgatagcctgacggctgcggtaccggtctttgcttgcttgttgttactggtattcaggacgctttaacggaaggtaatatgctgagttttctctgggatttggcttcgttcatcgttgcactgggtgtacttatcaccgtgcatgaatttggtcatttctgggttgcccggcgttgtggtgttcgcgttgagcgtttctcaatagggtttggtaaggcgctctggcggcgaactgataagctcggcaccgaatatgttatcgccctgatcccgttgggcggttatgtcaaaatgctggatgagcgcgcagaaccggtcgttccggaactccgccaccatgccttcaataataaatctgtcggccaacgagcggcgattattgccgcaggtccggttgcaaacttcatttttgctatctttgcctactggctggtttttattattggtgtgcctggcgtacgtccggtggttggtgaaatagcagccaattcgatagctgcggaagcacaaattgcaccaggtacggaactaaaagccgtagatggtatcgaaacgcctgattgggatgctgtgcgtttgcagttggtcgataaaattggcgatgaaagcaccaccattacggtagcgccatttggcagcgaccaacggcgggatgtaaagctcgatttacgtcactgggcgtttgagcctgataaagaagatccggtatcttcgttggggattcgtcctcgtgggccgcaaattgaacctgtactggaaaatgtgcagccaaactcggcggcaagcaaggcaggtttgcaagcaggcgacaggatcgttaaagtcgatggtcagcccttaacgcagtgggtgacctttgtgatgcttgtccgggataacccgggtaaatccttagcgttagaaatcgaaaggcaggggagtcccttgtctttgacattaatcccggagagtaaaccgggtaagggtaaagcgattggttttgtcggtattgagccgaaagtcattcctttgccagatgagtataaagttgtacgccagtatgggccgttcaacgctatcgtcgaagccacggacaaaacgtggcagttgatgaagctgacggtcagtatgctgggaaaattgatcaccggtgatgtgaaactgaacaacctcagtgggccgatctctatcgccaagggggctgggatgacagcggaactcggggtagtttattacctgccgtttcttgcgcttattagcgtgaacttagggataattaacctgtttccgttgcccgtacttgacggggggcatctgctgttccttgcgatcgaaaagatcaagggcggaccggtatccgagcgggttcaagacttttgttatcgcattggctcgattctgctggtgctgttaatggggcttgcacttttcaatgatttctctcggttatgagagttagttaggaagaacgcataataacgatggcgatgaaaaagttgctcatagcgtcgctgctgtttagcagcgccaccgtatacggtgctgaagggttcgtagtgaaagatattcatttcgaaggccttcagcgtgtcgccgttggtgcggccctcctcagtatgccggtgcgcacaggcgacgcggttaatgatgaagatatcagtaataccattcgcgctctgtttgctaccggcaactttgaggatgttcgcgtccttcgtgatggtgatacccttctggttcaggtaaaagaacgtccgaccattgccagcattactttctccggtaacaaatcggtgaaagatgacatgctgaagcaaaacctcgaggcttctggtgtgcgtgtgggcgaatccctcgatcgcaccaccattgccgatatcgagaaaggtctggaagacttctactacagcgtcggtaaatatagcgccagcgttaaagctgtcgtgaccccgctgccgcgcaaccgtgttgacctaaaactggtgttccaggaaggtgtgtcagctgaaatccagcaaattaacattgttggtaaccatgctttcaccaccgatgaactgatctctcatttccaactgcgtgacgaagtgccgtggtggaacgtggtaggcgatcgtaaataccagaaacagaaactggcgggcgaccttgaaaccctgcgcagttactatctggatcgcggttatgcccgtttcaacatcgattctacccaggtcagtctgacgccagataaaaaaggtatttacgtcacggtgaacatcaccgaaggcgatcagtacaagctttctggcgttgaagttagcggcaatcttgccgggcactccgctgaaattgagcaactgactaagatcgagccgggcgagctgtataacggcaccaaagtgaccaaaatggaagatgacattaaaaagcttcttggtcgctatggttatgcctatccgcgcgtacagtcgatgcctgaaattaacgatgccgacaaaaccgttaaattacgcgtgaacgttgatgcgggtaaccgtttctatgtgcgtaagatccgttttgaaggtaacgatacctcgaaagatgctgtcctgcgtcgcgaaatgcgtcagatggaaggtgcatggctggggagcgatctggtcgatcagggtaaggagcgtctgaaccgtctgggcttctttgaaactgtcgataccgatacccaacgtgttccggggagcccggatcaggttgatgtagtttacaaggtgaaagaacgtaacaccggtagcttcaacttcgggattggttacggtactgaaagtggcgtgagcttccaggctggtgtgcaacaggataactggttaggtacgggttatgctgttggtatcaacgggaccaaaaacgattaccagacctatgctgaactgtcggtaaccaacccgtacttcaccgtagatggcgtaagcctcggtggtcgtctcttctataatgacttccaggcagatgacgccgacctgtccgactataccaacaagagttatggtacagacgtgacgttgggcttcccgatcaacgaatataactcgctgcgtgcaggtctgggttatgtacataactccctgtccaacatgcagccgcaggttgcgatgtggcgttatctgtactctatgggtgaacatccgagcacctctgatcaggataacagcttcaaaacggacgacttcacgttcaactatggttggacctataacaagcttgaccgtggttacttcccgacagatggttcacgtgtcaacctgaccggtaaagtgaccattccgggatcggataacgaatactacaaagtgacgttagacacggcgacttatgtgccgattgatgacgatcacaaatgggttgttctgggtcgtacccgctggggttatggtgatggtttaggcggcaaagagatgccgttctatgagaacttctatgccggtggttccagcaccgtgcgtggcttccagtccaataccattggtccgaaagcagtttacttcccgcatcaggccagtaattatgatccggactatgattacgaatgtgcgactcaggacggcgcgaaagatctgtgtaaatcggatgatgctgtaggcggtaacgccatggcggttgccagcctcgagttcatcaccccgacgccgtttattagcgataagtatgctaactcggttcgtacttccttcttctgggatatgggtaccgtttgggatacaaactgggattccagccaatattctggatatccggactatagtgatccaagcaatatccgtatgtctgcgggtatcgcattacaatggatgtccccattggggccgttggtgttctcctacgcccagccgttcaaaaagtacgatggagacaaggcagaacagttccagtttaacatcggtaaaacctggtaagtgttctccacaaaggaatgtagtggtagtgtagcgatgactttaggcgatcaatataagatcgccgggccacgcaaagaactgcaccctccggtgcaaatgggatggtaaggagtttattgtgaaaaagtggttattagctgcaggtctcggtttagcactggcaacttctgctcaggcggctgacaaaattgcaatcgtcaatatgggcagcctgttccagcaggtagcgcagaaaaccggtgtttctaacacgctggaaaacgagttcaaaggccgtgccagcgaactgcagcgtatggaaaccgatctgcaggctaaaatgaaaaagctgcagtccatgaaagcgggcagcgatcgcactaagctggaaaaagacgtgatggctcagcgccagacttttgctcagaaagcgcaggcttttgagcaggatcgcgcacgtcgttccaacgaagaacgcggcaaactggttactcgtatccagactgctgtgaaatccgttgccaacagccaggatatcgatctggttgttgatgcaaatgccgttgcttacaacagcagcgatgtaaaagacatcactgccgacgtactgaaacaggttaaataagtaatgccttcaattcgactggctgatttagcgcagcagttggatgcagaactacacggtgatggcgatatcgtcatcaccggcgttgcgtccatgcaatctgcacaaacaggtcacattacgttcatggttaaccccaaataccgtgagcatttaggcttgtgccaggcgtccgcggttgtcatgacccaggacgatcttcctttcgcgaaaagtgccgcgctggtagtgaagaatccctacctgacttacgcgcgtatggcgcaaattttagataccacgccgcagcccgcgcagaacattgcacccagtgcagtgattgacgcgacggcgaagctgggtaacaacgtatcgattggcgctaacgcggtgattgagtccggcgttgaactgggcgataacgtgattatcggtgccggttgcttcgtaggtaaaaacagcaaaatcggtgcaggttcgcgtctctgggcgaacgtaaccatttaccatgagatccagatcggtcagaattgcctgatccagtccggaacagtggtaggcgcagacggctttggttatgccaacgatcgtggtaactgggtgaagatcccacagattggtcgcgtaattattggcgatcgcgtggagatcggtgcctgcactaccattgatcgtggcgcgctggatgacactgttattggcaatggtgtgatcattgataaccagtgccagattgcacataacgtcgtgattggcgacaatacggcagttgccggtggcgtcattatggcgggcagcctgaaaattggtcgttactgcatgatcggcggagctagcgtaatcaacgggcatatggaaatatgcgacaaagtgacggttacgggcatgggtatggtgatgcgtcccatcactgaaccaggcgtctattcctcaggcattccgctgcaacccaacaaagtctggcgcaaaaccgctgcactggtgatgaacattgatgacatgagcaagcgtctgaaatcgcttgagcgcaaggttaatcaacaagactaacgttccatcttttgttcgccaaactttacggcctgtctcattcttacgattgcggcaggccgtgttattattgtcgtttcttatattttgacaggaagagtatcttgactactaacactcatactctgcagattgaagagattttagaacttctgccgcaccgtttcccgttcttactggtggatcgcgtgctggattttgaagaaggtcgttttctgcgcgcagtaaaaaatgtctctgtcaatgagccattcttccagggccatttccctggaaaaccgattttcccgggtgtgctgattctggaagcaatggcacaggcaacaggtattctggcgtttaaaagcgtaggaaaactggaaccgggtgagctgtactacttcgccggtattgacgaagcgcgctttaagcgcccggtcgtgcctggcgatcaaatgatcatggaagtcactttcgaaaaaacgcgccgcggcctgacccgttttaaaggggttgctctggtcgacggtaaagtagtttgcgaagcaacgatgatgtgtgctcgtagccgggaggcctgatacgtgattgataaatccgcctttgtgcatccaaccgccattgtggaagagggcgcgtcgattggcgcgaacgctcacattggtcctttttgtatcgttggaccccatgtcgaaattggtgagggtaccgtactgaaatctcacgttgtcgtgaatggtcatactaaaattggccgcgataatgagatttatcagttcgcctccatcggcgaagttaaccaggatctgaaatatgctggcgaaccgacccgcgtggaaatcggcgatcgtaaccgcattcgcgaaagcgtcaccattcatcgtggcacagtccagggcggtggattgacgaaggtgggcagcgacaacttactgatgatcaatgcgcacattgcgcacgattgtacggtaggtaaccgctgcatcctcgccaacaacgcaacgctggcgggtcacgtatcggttgacgacttcgcgatcatcggcggcatgaccgcagtccatcagttctgcatcattggtgcgcatgtgatggttggcggctgctccggtgtggcgcaggacgtccctccttatgtcattgcgcagggtaaccacgcaacgccgttcggtgtcaatatcgaagggctgaagcgccgcggattcagccgtgaggcgattaccgctatccgcaatgcgtataagctgatttatcgtagcggtaaaacgctcgatgaagtgaaaccggaaattgctgaactggcggaaacatatccggaagtgaaagcctttaccgatttctttgcacgctcaacgcgcggtctgattcgttaatgactgaacagcgtccattaacgattgccctggtcgccggagaaacctccggcgatatcctgggggccggtttaatccgcgctctgaaagaacgtgtgcccaacgcccgctttgttggtgttgccgggccacgaatgcaggctgaaggctgcgaagcctggtacgaaatggaagaactggcagtgatgggcattgttgaagtgctcggtcgtctgcgtcgcttactacatattcgtgccgatctgacaaagcgttttggcgaactgaagccagatgtttttgttggtattgatgcgcctgacttcaatattactcttgaaggtaacctcaaaaagcagggtatcaaaaccattcattacgtcagtccgtccgtctgggcgtggcgacagaaacgcgttttcaaaataggcagagccaccgatctggtgctcgcatttctgcctttcgaaaaggcgttttatgacaaatacaacgtaccgtgccgctttatcggtcataccatggctgatgccatgccattagatccagataaaaatggtgcccgtgatgtgctggggatcccttacgatgcccactgtctggcattgttgccgggcagccgtggtgcagaagtcgaaatgcttagtgccgatttcttgaaaacggcccagcttttgcgccagacatatccggatctcgaaatcgtggtgccgctggtgaatgccaaacgccgcgagcagtttgaacgcatcaaagctgcagtcgcgccagacctgtcggttcatttgctggatggaatgggccgtgaggcgatggtcgccagtgatgcggcgctactggcgtcgggtacggcagcactggagtgtatgctggctaaatgcccgatggtagttggatatcgcatgaagcctttcaccttctggctggcgaagcgactggtgaaaactgattatgtctcgctgccaaatctgctggcgggcagagagttagtcaaagagctattgcaggaagagtgtgagccgcaaaaattggctgcggcgctgttaccgctgttggcgaacgggaaaaccagccatgcgatgcacgacaccttccgcgagctgcatcagcagatccgctgcaatgccgatgagcaggcggcacaagccgttctggagttagcacaatgatcgaatttgtctatccgcacacgcagctggttgcgggtgtggatgaagtcggacgcgggccgttagttggcgcggtcgtcaccgctgcggtgatccttgacccggcgcgcccaattgccgggctgaatgattccaaaaagctgagcgaaaaacgccgtctggcgctctgtgaagagatcaaagagaaagcgttgagctggagtctgggccgcgcggaacctcacgaaatcgacgaactgaatattttacatgcgaccatgctggcgatgcagcgtgccgtcgctggactgcatattgcgccggaatatgtgttgattgatggtaaccgctgcccgaaattaccgatgccttcgatggctgtggtgaaaggcgatagccgcgtaccggaaatcagtgccgcgtctatcctggcgaaagtgacgcgtgacgccgaaatggcagcgctggatattgttttcccgcaatatggttttgcccaacacaaagggtatccaaccgcttttcatctggaaaaactggctgaacacggcgcgaccgaacaccatcggcgcagctttgggcctgtcaaacgcgcactgggacttgcgtcctgattcttgtgtcgagattaagtaaaccggaatctgaagatgtctgaaccacgtttcgtacacctgcgggtgcacagcgactactcgatgatcgatggcctggccaaaaccgcaccgctggtaaaaaaggcggcagcgttgggtatgccagcactggcgatcaccgatttcaccaacctttgcggtctggtgaagttctacggagcgggacatggcgcagggattaagcccatcgtcggggcggattttaacgtccagtgcgacctgctgggtgatgagttaactcacctgacggtgctggcggcgaacaataccggctatcagaatctgacgttgctgatctcaaaagcgtatcagcgcgggtacggtaccgccgggccgatcatcgatcgcgactggcttatcgaattaaatgaagggttgatccttctttccggcgggcgcatgggcgacgttggacgcagtcttttgcgtggtaacagcgcgctggtagatgagtgtgtcgcgttttatgaagaacacttcccggatcgctattttctcgagctgatccgcaccggcaggccggatgaagaaagctatctgcacgcggcggtggaactggcggaagcgcgcggtttgcccgtcgtggcgactaacgatgtgcgctttatcgacagcagcgactttgacgcacacgaaatccgcgtcgcgatccacgacggctttaccctcgacgatcctaaacgccctcgtaactattcgccgcagcaatatatgcgtagcgaagaggagatgtgtgagctgtttgccgacatccccgaagcccttgccaacaccgttgagatcgccaaacgctgtaacgtgaccgtgcgccttggtgaatacttcctgccgcagttcccgaccggggacatgagcaccgaagattatctggtcaagcgtgcaaaagagggcctggaagagcgtctggcctttttattccctgacgaggaagaacgtgttaagcgccgcccggaatatgacgaacgtctggatactgaacttcaggttatcaaccagatgggcttcccgggttacttcctcatcgttatggaatttatccagtggtcgaaagataacggtgtaccggtagggccaggccgtggttctggtgcagggtcactggtggcctacgcgttaaaaatcaccgatctcgatccgctggaatttgacctgctgttcgaacgtttccttaacccggaacgtgtctccatgcctgacttcgacgttgacttctgtatggagaaacgcgaccaggttatcgagcacgtagcggacatgtacggtcgtgatgcggtatcgcagattatcaccttcggtacgatggcggcgaaagcggtgatccgcgacgtaggccgcgtgctggggcatccgtacggctttgtcgaccgtatctcgaaactgatcccgcccgatccggggatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcaccgaccaaaattaccgattttgcgccgctttactgcgatgaagagggcaaacatccggtcacccagtttgataaaagcgacgttgaatacgccggactggtgaagttcgacttccttggtttgcgtacgctcaccatcatcaactgggcgctggagatgatcaataagcggcgggcgaagaatggcgagccgcctctggatatcgccgcgatcccgctggatgacaagaaaagcttcgacatgctgcaacgctcggaaaccacggcggtattccagcttgaatcgcgcggcatgaaagacctgatcaagcgtctgcaacctgactgcttcgaagatatgatcgcactggtggcacttttccgccccggtccgttgcaatcagggatggtggataactttatcgaccgtaaacatggtcgcgaagagatctcctatccggacgtgcagtggcagcatgaaagcctgaaaccggtactggagccaacctacggcatcatcctgtatcaggaacaggtcatgcagattgcccaggtgctttctggttataccctcggtggcgcggatatgctgcgtcgtgcgatgggtaagaaaaagccggaagagatggctaagcagcgttctgtatttgctgaaggtgcagaaaagaacggaatcaacgccgaactggcgatgaaaatcttcgacctggtggagaaattcgcgggttacggatttaacaaatcgcactctgcggcctatgctttggtgtcatatcaaacgttatggctgaaagcgcactatccggcggagtttatggcggcggtaatgaccgccgatatggacaacaccgagaaggtggtgggcctggtggatgagtgctggcggatggggctgaaaatcctgccaccagatataaactccggtctttaccatttccacgtcaacgacgacggcgaaattgtgtatggtattggcgcgatcaaaggggtaggtgaaggcccgattgaggccatcatcgaagcccgtaataaaggcggctacttccgcgaactgtttgatctctgcgcccgtaccgacaccaaaaagttaaaccggcgggtgctggaaaaactgatcatgtccggggcgtttgaccgtcttgggccacaccgcgcggcgctgatgaactcgctgggcgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtgttagatggggaacgtgaaacgttaggtctgtacctcacgggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcgattgcgttttggcgcgacgtggcgtgtctctccgagcgatcgtttattaaacgatctccgtggcctcattggttcggagcaggtggaactggagtttgactaatacaggaatactatgagtctgaatttccttgattttgaacagccgattgcagagctggaagcgaaaatcgattctctgaccgcggttagccgtcaggatgagaaactggatattaacatcgatgaagaagtgcatcgtttgcgtgaaaaaagcgtagaactgacgcgtaaaatcttcgccgatctcggtgcatggcagattgcgcaactggcacgccatccacagcgtccttataccctggattacgttcgcctggcatttgatgaatttgacgaactggctggcgaccgcgcgtatgcagacgataaagctatcgtcggtggtatcgcccgtctcgatggtcgtccggtgatgatcattggtcatcaaaaaggtcgtgaaaccaaagaaaaaattcgccgtaactttggtatgccagcgccagaaggttaccgcaaagcactgcgtctgatgcaaatggctgaacgttttaagatgcctatcatcacctttatcgacaccccgggggcttatccgggcgtgggcgcagaagaacgtggtcagtctgaagccattgcacgcaacctgcgtgaaatgtctcgcctcggcgtaccggtagtttgtacggttatcggtgaaggtggttctggtggtgcgctggcgattggcgtgggcgataaagtgaatatgctgcaatacagcacctattccgttatctcgccggaaggttgtgcgtccattctgtggaagagcgctgacaaagcgccgctggcggctgaagcgatgggtatcatcgctccgcgtctgaaagagctgaaactgatcgactccatcatcccggaaccgctgggcggtgctcaccgtaacccggaagcgatggcggcgtctctgaaagcgcagctgctggcggatctggccgatctcgacgtgttaagcactgaagatttaaaaaatcgtcgttatcagcgcctgatgagctacggctacgcgtaatcggcaaatgttctgaaaagggtcacttcggtggcccttttttatcgccacggtttgagcaggctatgattaaggaaggattttccaggaggaacacatgaacatcattgccattatgggaccgcatggcgtcttttataaagatgagcccatcaaagaactggagtcggcgctggtggcgcaaggctttcagattatctggccacaaaacagcgttgatttgctgaagtttatcgaacataacccacgaatttgcggcgtgatttttgactgggatgagtacagtctcgatttatgtagcgatatcaatcaacttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtgcaccaacgaatatcttgataacattacgccgccgttcacgaaagccttgtttacctacgtcaaagagcggaagtacaccttttgtacgccggggcatatgggcggcaccgcatatcaaaaaagcccggttggctgtctgttttatgattttttcggcgggaataccctcaaggcggacgtctctatttcggtcaccgagcttggttcgttgctcgaccacaccgggccacacctggaagcggaagagtacatcgcgcggacgtttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattctgggtgggatcccgcgcggtgaatttactcgcgacagcatcgaagagaaagtcgctgccaccacgcaggcacaatggccggttcatgcggtgatcaccaactccacctatgatggcttgctctacaacaccgactggatcaaacagacgctggatgtcccgtcgattcacttcgattctgcctgggtgccgtacacccattttcatccgatctaccagggtaaaagtggtatgagcggcgagcgtgttgcgggaaaagtgatcttcgaaacgcaatctacccacaaaatgctggcggcgttatcgcaggcttcgctgatccacattaaaggcgagtatgacgaggaggcgtttaacgaagcctttatgatgcataccaccacctcgcccagttatcccattgttgcttcggttgagacggcggcggcgatgctgcgtggtaatcctggcaaacggctgattaaccgttcagtagaacgagctctgcattttcgcaaagaggtccagcggctgcgggaagagtctgacggctggttttttgatatctggcaaccgccgcaggtggatgaagccgaatgctggcccgttgcgcctggcgaacagtggcacggctttagcgatgcggatgccaatcacatgtttctcgatccggttaaagtcactattttgacaccggggatggacgagcagggcaatatgagcgaggaggggatcccggcggcgctggtggcaaaattcctcgacgaacgtgggatcgtagtagagaaaactggcccttataacctgctgtttctctttagtattggcatcgataaaaccaaagcaatgggattattgcgtgggttgacggaatttaagcgctcttacgatctcaacctgaggatcaaaaatatgctacccgacctctatgcagaagatcccgatttctaccgcaatatgcgtattcaggatctggcgcaagggatccataagctgattcgtaaacacgatcttcccggtttgatgttgcgggcatttgataccttgccggagatgatcatgacgccacatcaggcatggcagagacagattaaaggcgaagtagaaaccattgcgctggaacaactggtcggtagggtgtcggcaaatatgatcctgccttatccacccggcgtaccgctgctgatgccgggagaaatgcttaccgaagagagccgcacggtactcgattttctactgatgctttgttccgtagggcaacattaccccggttttgaaacggatattcacggcgcgaaacaggacgaagacggtgtttaccgcgtacgagtcctaaaaatggcaggataacttgccagagcggcttccgggcgagtaacgtgctgttaacaaataaaggagacgttatgctgggtttaaaacaggttcaccatattgcgattattgcgacggattatgcgatgagcaaagctttctactgcgatattcttggtttcacgctgcaaagcgaagtctatcgcgaagcgcgcgactcgtggaaaggggatttggcgcttaatgggcaatatgtgattgagcttttctcatttccgttcccgccggagcgccccagccgaccggaagcttgcggcctgcgtcatctggcttttagcgttgatgatatcgatgcggcagtggcgcaccttgaaagccataacgtgaagtgtgaagccatccgtgtcgatccctacacgcaaaaacgcttcacgttctttaacgatccggacgggctgccgttggaactgtatgagcagtaaggcttgtcatcgccgcatttgcccggtaacgtgcccggcattgctactgtaaaatcgcaccatcatgacactcacgctcaatagacaacttctctcctcacgccagattctggtggcctttagcggcggccttgattctactgtcttactgcatcaactggtgcagtggcggacggaaaatccgggcgtcactctgcgcgctatccatgtgcatcacggtttaagcgccaatgctgatgcctgggtgaaacattgtgaaaacatctgccaacagtggcaggtgccgctggtggtcgaacgtgtgcagcttgcgcaagaggggctaggtattgaggcccaggcgcggcaggcacgttatcaggcatttgcccgcaccttgttgcccggtgaagtgctggttacagcgcaacatctcgacgatcaatgtgaaacctttctgctggcgctaaaacgcggtagcggccctgccgggctttcggctatggcggaagtttcggagtttgccggaacacggcttatccgcccgttgcttgcccgcacgcggggggaactggagcagtgggcgttagcgcatggtttacgctggattgaagacgaaagtaatcaggatgactcatacgatcgtaactttctgcgcctgcgcgtagtgccattattgcagcagcgttggccgcattttgccgaagcaacagcccgcagcgccgcactttgcgctgaacaagagagcctgttagatgaactgctggcggatgatttagcgcactgccaaacgcaacagggaacgttaaagattgcgccaatggtggcaatgagcgatgcccgtcgcgcggcgattatccgccgctggctggcagggcagaatgcaccgatgccttcccgcgacgcgttggtgaggatctggcaggaagtggcgctggcgcgagaagatgcttccccctgtttacgtttgggtgcgtttgaaatccgccgctatcagtcgcaactgtggtggattaaatccgtcactgggcaaagcgaaaccattctgccgtggcagacgtggctacaaccgctggaattaccggcggggctgggaagtgtacagcttactgcgggaggcgatattcgccctccgcgtgcagacgaagcggtcagcgtgcgtttcaaagcgccaggattgctgcatattgtcgggcgcaacggcggacgtaagctgaagaaaatctggcaagagttaggcgttccgccgtggctacgtgacaccacgccactgctgttttatggcgaaacgctgattgcggcggcaggggtatttgtgacgcaagaaggtgtggctgtaggtgagaatggcgtcagttttgtctggcagaaaacgcttagtcaagtgaaagccggataagacgcatcaaacgtcgcatccggcgaaagtcaatcaggactcgctcaccaccaccgtaccgatttccgggtggctaaagctggtaattttatccagacgcagctcgcgggttgcaccagcggcctcgacgaccagatactccacatttttgcgggagactaaatcgctggccttcgcctgcaatttttcgccatctttcagctcaagtgtcagcattaaatgatgctggcaggcgagctcaagattatcgtaatcatcacaattgattggttgatacgtatcattcattgacataatcgctcaccagtaagtttgccgcagcgtatgctgctttttccctgacagcctcagaaagggcgtcgtcggcagccatttcattcagcactttcaaaacgcagcccagcgcgtccggaacgtatcctaagtctccgctggcgatttccgcgtaccgcttgcgtattaactcacaatatttttccacatgccctcctgtcagcactctgacttaaccgtggatgcaagtctaagcctacgaagataaactctgtttcgcaaggtgactataccacactcatttctgcaatatcagcgccgcaactgcacgtattccgttacaatggcctcctgattcgaaaggagttttcttatggcgcttaaagcgacaatttataaagcgacggttaatgtggccgatctcgaccgcaaccagtttctcgatgcctctctgacgctggcgcgccatccttcagaaacccaggagcgcatgatgctgcgcctgctggcgtggctaaaatatgccgatgaacgtctgcaatttacccgtggtttgtgtgctgatgatgagccggaagcgtggctgcgtaacgatcatttgggtattgatttgtggattgagctggggctgccggatgagcgacggattaagaaagcctgcacccaggccgcagaagtggcgctgtttgcctataatagtcgggcggcgcaaatctggtggcagcaaaatcagagcaaatgtgcgcagtttgccaatctttccgtctggtatctggacgacgagcaactggcgaaagtgagcgcctttgccgatcgtactatgacgctgcaggcaacgattcaggatggtgttatctggttatcggatgataagaataatctggaagtgaacttaaccgtctggcaacaaccttcatgattgtgatttcccgacatgttgctatccctgatggcgagtttgagatcaccgccattcgtgcgcagggcgcgggcgggcagcatgttaataagacctcaacggctattcatctgcgttttgacattcgggcgtccagcctgccagagtattacaaagagcgtctgctcgccgccagccatcatttgatcagcagtgacggagtgattgtcattaaggcacaggaataccgcagtcaggaactgaaccgcgaagcggcgctggcccggctggtggcagtgattaaagatttaacaacagaacaaaaagcccgacgacctacgcggcccacccgtgcatcaaaagagcgcaggctggcatcgaaagcacaaaaatcaagcgtgaaggcgatgcgcggcaaagtgcgcagcggtcgggaataaaaagaaggaatggatggtgaaaaaagcgatagtgacagcgatggctgtaatcagcctctttactctgatgggatgtaataatcgggccgaagtcgatacgctttctccggcgcaggctgccgaactgaaaccgatgccgcaaagttggcgtggcgtgctgccgtgtgctgattgcgaaggaatcgaaacctctctgttcctcgaaaaagacggaacctgggtgatgaatgaacgttatctgggggctcgtgaagaaccttcctccttcgcttcctacggtacatgggcgcgaaccgctgacaagctggtattaaccgatagcaaaggtgaaaagtcatattatcgcgcgaaaggagatgcgctggagatgctcgatcgtgaaggtaatccgattgaatcgcagttcaactacacgctggaaccggcacaatccagcttacccatgacgccgatgaccctgcggggcatgtatttttatatggctgatgcggcgaccttcactgattgcgcgaccggaaaacgtttcatggtggcgaataacgcagagctggagcgtggctacctggctgcgcgcggtaacagtgaaaaaccagtgttactgtcagttgaaggtcactttacgctggaggctaatcccgataccggtgcgccgactaaagtattagcgcccgatacggcaggtaaattttacccaaaccaggattgcagtagtttggggctgtaacccgtcttgagacagaaacaaatgaaatattgcctcatgcgctgcgcttatcaggcctaaagcatacaatgcaatattttgaattagcacgattttgtaggccggataaggcgttcacgccgcatccggcattttgcgcacgaggctggcttttatcactgagtcagtccaacaaagcgacttgctttaatataaatccctggcttcaggtgcccaatatactgtaactgcgtttctggtttaaatgcagagacatcaccactacgcatatgcatcagatcggcagggctaatccagcctgattgcgccagcgtaagcggatgcccggctttggcaaatgcatcagtgacaaattccgaacaaaaccacgactttttgtctccttcgcccacactgcttaactgcgctttcgccaggccgctgacgcactgttgacgaaaatcctcggagaacggatttagtgagcacatctggcgagtcaccataaatggaataaattcgacaatgccgcgatagttgtaaccgctatctttaattttgttggtgaacgcggtgatttctgtggcttgttgcggggtaagatccgggactcgtaagacgaaaagcttatcactatgctttatggcttttttaagggaaacaatctggacgccagcgcctgtcgcttcggcaacgttattatctcccaaatagattgcaacgtgactcacagaggaagtgctgaatacgcggataccaaatgaggttaccccaaggcttgaggagaaaagcaaatcgccgggtttgagatctggttccgttatttcttttattgattgttcggtgaaagagctttgatgctggaatttaacagcccatgttttcgcctcggcatttaccactgtggctgatgagtctggctggctgatatcaacggtacaggccgaaagtaaaagaaagcaggggagaagcaggcggcagtacgcctttggtttatccattttatacaatccatgtaaaaaagggccccgaaattcaggaccctttctggcatcagcctttaatctgtttcaccagataatcgacgatgtcaccagtcttaattaactgtttctcgccgttacgacgatatttatattcgatatcatcgttgtcgaggttacggtcgcccagcacaatagtgtgcggaataccgatcagttccatatcagcaaacatcacgcccggacgctctttgcggtcatccagcagcacttcgataccttgtgcgcgcagttcgctgtacagtttctcagcaagttcctgtacgcggaaggatttgtgcatgttcattggcagaatcgccacctggaacggcgcgatagcgtcaggccatacgatgccgcgttcgtcgtagttctgctcaatcgccgcagctaccacacgcgttacgccgataccgtagcaacccatcgtcaggatttggttacggccatcttcaccctgtacggaggctttcagtgcttcggagtacttggtacccagctggaagatgtgaccgacttcgataccacgtttgatcagcagcgtaccctgaccatccgggcttggatcgccagccaccacgttgcggatatcagcaatttccggggtagcgacatcgcgatcccagttgataccgaagtagtgtttaccatcgatgttagcaccagcagcgaaatcactcatcgccgcaacggtacggtcaatcaccaccggaatcggcatgtttaccggacccagtgaacccggaccggctttaaccacggcacgaatttcttcttcggtcgcaaaagtcagcgggctggcaacctgcggcagtttttctgctttaacttcgttcagctcgtggtcaccgcgcaccagcagcgcaaccagcgggaagctactgccttcaacggctttaaccagcagagtcttaaccgttttctcaatcggcagattgaactgttcaaccagttccgcgatggtcttcgcgttcggcgtatcaaccagcgtcatttcctgggtagcagcagcgcgcggttctttcggcgcgatagcttctgccagttcaatgttcgctgcatagtcagaagtatcggagaagaccacatcgtcttctccgctctgcgccagcacctgaaattcgtgagaggcgctaccgccgatagaaccggtatcggcctgtacggcgcggaaatccagccccatgcggctgaagattttgctgtaggccgcatacattgcatcgtaggtttcctgcagggattcctgagaagtatggaaagagtaagcatctttcatcaggaattcgcgggaacgcatgacgccgaaacgcggacgcacttcgtcgcggaacttggtctggatctgatagaagttcagcggcagctgtttgtaagagctcagctcgttacgaatcaggtctgtaatcacttcttcatgagttgggccgagtacgaacggacggtcaccacggtcagcaatacgcagcaattccgggccatactgttcccaacgaccactctcttgccacagttcagatggctgaaccaccggcattaacacctcgatcgcaccggcgttgttcatctcttcacgcacgatgttttcgacttttttcagaacgcgcacgccggtcggcagccaggtatataacccggaggccagcttgcggatcatcccggcgcgcagcatcagctgatggctgatcacctcggcgtcggcaggtgtctccttgagagtggagagcaggtattggctagtacgcatgttgttacggttccagttggaaggtagaacaggctcaaggcgagcctgggacaaaaaaagtgatttagtttaccagtgcaaaagaaatgtcaaaagagaagggcgtgaatttaacgcggttccagcgcaaagacttcaaaacctgcgtcggtgacgcgccagcgaacgttaaaatcatgcagccagacggcataggttttgcccgtttcctcacctttacgataggccgggcgcgggtcctgcgccagtacttcgcggataaacagcgttaactgcggataacgcttcttcagcgtcaaaagctgcttttcgacctctgcggtaaaacacaccgccatttctgccgctggcgcactttgcgcatagctggcactggcatcgggaagcgattcagcaaaggggagatacggtttgatatccactaccggcgtaccatcgaccagatccagactgccgagcttcagaatcacgctatctttatggcaaacaacctctttcagctctaccagcgacataccaatcgggttagggcgaaaagtggagcgcgtagcgaaaacacccattctggcattaccgccgagacgaggcggacgcacagtcggacgccagccgccttccatcgtttgatgaaagacgaaaaggatccataaatggctgaatgcttccaggccgcgaacggcgtcggcctggttgtagggagcaatgagatgtagttcgccgttggcgctttttaccagacctggctggcgcggaacggcgaatttttctttatagggcgagcgaataacgcctatttgctcgaactggaaactgctcatttcgccgtgatgttaagcgcagaaccgatacatacagcctgacgatagcaacctggcgtaccgctggtgacttcgcagctatgcagtaataccgcattggctttcattttcgaggcgttgatttgcatccgcttacgtgcggttggaatgctcggcggagagtcctgattagaggcctggcaagagtcgccactgacttcaccgagatcgcggaacggtttgccgactaattcttctgcattggtataaattcggaccggcgtggcgcgcggcgctttcggttttgcaggctccgctttcggctggggtgcagtgctttgaacgggttcgacaggggatctgcttaacatggaacagccgcttagcatgagtgctactaaacagatcggtaaagcacgcatagtatttcctcaatgtatgatcaaaacgtcaatattgaatcaggcgcttgtaaaaatgacaagacgggcaagcgcccgtcctgaatgatattacaaattgtggaaacagcctaaatattaccagcctttaacagcgccgccgttaaacactttgtttgctgcttcgtaaacttcgtcagactgataagcctgaacgaatttcttcacgttttcggcgtctttgttgtcttcacgcgttacgatcagatttacgtacggggactctttatcttcgacaaagataccgtctttcgctggagtcaggccaatctggctggcataggtggtattgataactgccagagcgatttgcgcgtcgtccagagagcgcggcagctgcggtgcttccagttcaacaattttcagattttttgggttctcaacaacatcaagaacggtcggcagcaggccaacgccatctttcagtttgatcaagcccactttttgcagcagcagcagtgaacgaccaaggttagttgggtcgtttggcacggcaacctgcgaaccatcctgcagttcatccagtgatttgattttcttggagtaaccagcaatcggataaacaaaagtgttgcctactgcgaccagtttgtagccacgatctttcagttgctgatcaaggtacggtttatgctggaaggcgttggcgtcgatatcgcctttgctcaatgcttcgtttggcagaacatagtcgttgaaggttaccagctcaacgtccaggccatatttgtctttcgcaactttctgcgcgacttctgcaacctgctgttcggcaccaacaatcacgccgactttaatgtggtttggatctttttcatcctgaccgcagcctaccagtgccagtgatccaatcagggctcccactgccgcaaaggttttgaatttgaacgccataccttattccttcttcaattatttatgttgtgttgaacgttacttgcgagtgacagcccggacgatgcggtcgcctgcgaactgaattaaataaaccagaatgaccagcaataccagtaccgtattcatcaccgtcgcgttgtagccgatgtagccatactgatagccaatctgacctaaaccaccggcaccgactgcaccacccatcgcggaataaccaaccagggtaatcagggtgatagttgccgcattcaccagacccggcaacgcttccggtaacagcactttacggacgatctgcattggcgtggcccccattgcgcgggaagcttcaattaacccggttgggatctccagcagagcgttctcgaccatacgggcaataaacggtgctgcaccaacggttaacggaacaatcgctgcctgcaatccaatcgatgtaccgacaataacgcgggtaaacggaatcatccataccagcaagataatgaacgggatggaacggaaaatgttcacaatcgcagaaatggtacgatacaacttcgcgttagcaataatttgccccggacgcgtgacataaagcagaacgccaaccggcagaccaatcacaaagccaaaaaaaccggatacgaaggtcattgccagcgtttcccatacgccacgaaccagcagccacatcatcggctcagacataacccagtacctctacttttacatggtgttcctgcagccaggcaatggcggcttgcgtatcttgttgtgtgccgtgcatttcagtcagcatgatgccgaacttaacgccaccggcgtaatccatctgcgcgctaataatgttgttgttgacgttgaaacgacgcgcggtttcagaaagcagtggggcatcgaccgattgaccggtaaactccagacgcagcatcggcacgcagtcagtaaatggctccgcttgcagacgttcctggtaatcttccgggatatccagatgcagggtcgactgaataaacttctgcgccagcggcgttttcggatgcgagaacacttcacttaccgtgtcctgctcgatcagttcgccattactgataaccgccacgcaatcacaaatacgcttcacaacgtccatttcgtgggtgatcaacagaatcgtcaaacccagacggcggttgatgtctttaagcagttcgagaatagaacgtgtcgttgccgggtccagcgcgctggtggcttcatcacacagcaatactttaggattgctggctaacgcacgggcaatcgccacacgctgtttctgcccaccggaaaggttcgacggatagctatcatgcttatcaccaagaccaaccaatgacagcaattccgtcacgcgacgtttgatttcgtctttcggcgtgttgtccagctccagcggcagagccacgttgccaaaaacagtacgcgaagagagcaggttaaaatgctggaaaatcataccaatctggcggcgagctttagtcaactcggattctgacagcgtggtcagctcctggccatcaaccagcacgctaccctcggttgggcgctccagcaggtttacacaacgtataagcgtactcttacccgcgcctgaggcaccgataacgccataaatttgtccagctggcacatgcaggctgacgttgttcaacgcctggatggtgcgggtgccctggtggaacactttggtgatattcgaaagttttatcattgattatttattatcgtcattaagttagtcgtggcatttcgaatgcctggaacgggcatcgccgtcaatgaaatggatgttaaggcatccagacgtctaaatcaatcaggtttatgcgaagagcactttcttgcaggtcgaaacatgcgatactagcgtcacatgccttattaaggagctataaaaggtggcgaagagcgtacccgcaatttttcttgaccgtgatggcaccattaatgttgatcacggctatgtccatgagatcgacaactttgaatttatcgacggtgttattgacgccatgcgcgagctaaaaaaaatgggctttgcgctggtggtagtaaccaaccagtctggcattgctcgcggtaaatttactgaagcacagtttgaaacgctgaccgagtggatggactggtcgctggcggaccgcgatgtcgatctggatggcatctattattgcccgcatcatccgcagggtagtgttgaagagtttcgccaggtctgcgactgccgcaaaccacatccggggatgtttttgtcagcacgcgattatttgcatattgatatggccgcttcttatatggtgggcgataaattagaagatatgcaggcagcggctgcggcgagcgtgggaacaaaagtgctggtgcgtacgggtaaacctattacgcctgaagcagaaaacgcggcggattgggtgttaaatagtctggcagaccttccgcaagcgataaaaaagcagcaaaaaccggcgtgatgattaaaagatgagcggttgaaataaaaatgcatttttccgcttgtcttcctgaaacgactccctataatgcgcctccatcgacacggcggatgtgaatcacttcacacaaacagccggttcggttgaagagaaaaatcctgaaattcagggttgactctgaaagaggaaagcgtaatatacgccacctcgcgacagtgagctgaaagccgcgtcgcaactgctctttaacaatttatcagacaatctgtgtgggcactcgaagatacggattcttgacgtcgcaagacgaaaaatgaataccaagtctcaggagtgaacacgtaattcattacgaagtttaattctttgagcatcaaacttttaaattgaagagtttgatcatggctcagattgaacgctggcggcaggcctaacacatgcaagtcgaacggtaacagaaagcagcttgctgctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgaagtgctcacacagattgtctgatgaaaatgagcagtaaaacctctacaggcttgtagctcaggtggttagagcgcacccctgataagggtgaggtcggtggttcaagtccactcaggcctaccaaatttgcaccgcaaatttgaagaggttttaactacatgttatggggctatagctcagctgggagagcgcctgctttgcacgcaggaggtctgcggttcgatcccgcatagctccaccatctctgtagtgattaaataaaaaatacttcagagtgtacctgcaaaggttcactgcgaagttttgctctttaaaaatctggatcaagctgaaaattgaaacactgaacaatgaaagttgttcgtgagtctctcaaattttcgcaacacgatgatgaatcgcaagaaacatcttcgggttgtgaggttaagcgactaagcgtacacggtggatgccctggcagtcagaggcgatgaaggacgtgctaatctgcgataagcgtcggtgaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatactgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcctcttaatggggtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtggcctgtgagggttgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaaccaaggctgaggcgtgatgacgaggcactacggtgctgaagcgacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcggcaacgcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttggcccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaaagattttcagcctgatacagattaaatcagaacgcagaagcggtctgataaacagaatttgcctggcggccttagcgcggtggtcccacctgaccccatgccgaactcagaagtgaaacgccgtagcgccgatggtagtgtggggtctccccatgcgagagtagggaactgccaggcatcaaatttagcagtaagccggttataaaccggtggttgtaaaagaattcggtggagcggtagttcagtcggttagaatacctgcctgtcacgcagggggtcgcgggttcgagtcccgtccgttccgccacttattaagaagcctcgagttaacgctcgaggttttttttcgtttgtatttctattattgccaaaatcgcaaaaatcctctgcgttttacgccatttttccacaactgtctgaagcccataatcacctcagttaacgaaaatagcattaaaagaggcatattatggctatccctgcatttggtttaggcactttccgtctgaaagacgacgttgttatttcatctgtgaaaacggcgcttgaacttgattatcgcgcaattgataccgcacaaatctatgataacgaagccgcagtaggtcaggcgattgcagaaagtggcgtgccacgtcatgaactctacatcaccactaaaatctggattgaaaatctcagcaaagacaaattgatcccgagtctgaaagagagcctgcaaaaattgcgtaccgattatgttgatctgacgctaatccactggccgtcaccaagcgatgaagtctctgctgaagagtttatgcaggcgctgctggaagccaaaaaacaagggctgacgcgtgagatcggtatttccaacttcacgatcccattgatggaaaaagcgattgctgctgttggcgctgaaaacatcgctactaaccagattgaactctctccttatctgcaaaaccgtaaagtggtcgcttgggctaaacagcacggtatccatattacttcctatatgactctggcgtatggcaatgcactgaaagataaggttattgctcgtattgcagctaaacacaatgcgactccggctcaagtgattctggcgtgggctatgggggaaggttactcagtaattccttcttctactaaacgtgaaaacctggagagtaatcttaaggcacaaaatttacagcttgatgccgaagataaaaaagcgatcgccgcactggattgcaacgaccgcctggttagcccggaaggtctggctcctgaatgggattaagcctctctgacagctcctccgggagctgtttttacatgtccgctaaggaaatcgataaaagcccggatgcgcgtacttaccgcacggtcgctgtaatagactgcactgaatggcatttccactggcaacactttatctgccattaactccaccaattctccgcgagcgatttctttgtcgatcatgtagtcggacaaacacgcaatcccgttgccactcaggcaaagctgtttcagtgtttccccactattggatgacaaaccgtacttcacctcatgtaattgtccatcgctacaggctatcggccaggtattgagggaagcgggttcagtgaatctcaggcaaatatgttgctttaaatcgtcgatcgtttctggcttcccgtagcaggaaatataatcgggggaggcgataatttttcgataactgttaaataacggcctggcacgtaagctggaatccgttaacgtaccggcgcgtatcgcgacatccacttttctttcgatcaaattaataatcgtttcggaggagactagcgataaagtgacttccggatagcgttcacgaaaaggcttaatcaacggcatcagaaagtgcagcaccactggagttgcggcatcgatccgtaacagtccacgcggtgtattacgcgtctccataatttctgattctgccgctgccatctcctgcaaaattgactgtacgcgatgaaaataacgctcgccttcttccgtcaggctaagttgccgcgtggtccgattaagcaggctaacgccaagtttcatctccagctttttcaccgcccggcttaccgctgagtttgcttgccctaattgttccgctgcccggctaaagctgccgctttcgacgactgaaacaaaaatggcgagttcttccgacgtggctttcatttttgctcctgttgcaaaatagaagagatattttgaatttatttgtcattaaaccatcaggatgcgagatatgccatccgatttaatgttctcaataatgagcaaaatcctgaccggtgtaagcacttgcttacataacaatatacaattgctcgttgaaagagtgagctaaaatccctataacagtagaaccctcccgagtgcggaagggttgacgtgatagaggtttcaaagtcaaaagtgcgaaaaaacacctatgccatgcgctatgttgccggacaacctgcggaaaggatcttaccgccggggtcttttgcgagcatcggccaggcattaccacctggagaaccgttaagtaccgaagagcgtattcggatcctggtgtggaacatatacaaacagcaacgcgctgaatggttgtcggtattaaagaactacggcaaagatgcacatctggtgttattgcaggaagcgcagacaacgccagagttagtacagtttgcgactgctaactatcttgccgccgatcaggtacccgctttcgtgctgccacaacatccttctggcgtaatgaccctttcggcggcacatccagtgtattgctgcccgttacgtgaacgagaacccattttgcgtctggcgaaatcggcactggtgacggtctatcccttacctgacacccgcctgttgatggtggttaatatacacgccgtcaacttcagtctgggcgtggatgtctatagtaagcagttacttcctattggcgatcagatagctcaccacagtggcccggtcattatggcgggagatttcaatgcctggagccgtagaaggatgaacgcgttatatcgctttgcgcgggaaatgtcgctacgccaggtgcgttttaccgatgatcagcgccgtcgggcgtttggtcgcccgctcgattttgttttctaccgtggtctgaacgtcagcgaagcttctgtactggttacgcgcgcttccgatcacaatccgctactcgttgaattcagtcccggcaagcctgataaataaggtatgtcaggtctgccacagggcagaccaacgtttggcgctgcccttttatactcaaacaacaaaaggacagcgcaatgacaacacaatcccaccatgaccacgtagaaaagcagtttagctctcaagccagcgaatatctgaccagtaccgtacatgcatccggacgagatttacagcgcctggcggtgcgtctggctgattatcctgatgcaagtgtacttgatatgggctgcggagcagggcatgccagctttgttgctgcgcaaaacgtgagcgcggtggtagcgtatgacttatctgcccaaatgctggatgtcgtggcacaagctgccgaagcccggcaactgaaaaatatcaccacccgccagggttatgccgaaagtctgccatttgccgataacgcatttgatattgttatcagccgttattctgcccatcactggcatgatgttggtgcagcactgcgtgaagtgaaccggatattgaaacctggcggtaggctgattgtgatggacgtaatgtctccgggccacccagtgcgcgacatctggttacagacggtagaagcattacgcgatacctctcacgtacgaaactacgccagcggtgagtggttgaggttaatcaatgaagccaatctgatagttgataatttaattacagataagttaccgctggaattttcttcatgggtcgcgagaatgcgtacgccagaagcgttagtagacgctattcgcatttaccaacagagcgcatcgacagaggtgaaaacgtattttgccttgcagaatgatggctctttcaccagtgatatcatcatggtagaagcacataaagcagcataaataaaaaaggcaccgggggaatcggtgcctttcattatctggtttgtcaggaatctggcatgttgttgtttttcacaaacaacgtcagcttatcgcctggttgcagattcgcagtatcgctgttccagcgcatcacatctttgatgttcacgccgtggcgtttagcaatgcttgaaagcgaatcgcctttgcgcacacgatacgtaatgctatcgctgttgtttgccaaccgctgtgcgctactacctgcgccaatcgtcaagctttggcctggcttcagcttagatccgcgcagtttgttccactgctgcaaatctttggtgctaacgccgagacgtgaagcgatacttgaaagcgtgtcgccagagcgtacggtgtaaacacggctgttaagcggcgtattgtcggcaaccagcgtcgactgtacagcagcaatttcgcccgaagccagagattcacgcagttgatctgcatgcttctttggcaccatcacgtactgcggaccacttgcgcccagcgtggagcctttcacgccagcgttgaatgtcttcagcttgctgacggaaatccccgccatatctgcaaccttcgccatttcaaccgggctgctcaggtgcacacgcgccagagcacggctttcatcggtcgttggcagacgtacgccataacgcttgctgtttttgagaatatcactcaatgccagcattttaggcacgtactgcttcgtttcctgcggcaacggtaacgaccagaagtccgtggatttcccacgcgctttgttcgttttaattgccttcatgacccgaccttcgccgctgttataagccgctacggtcagaagccagtcgccgtcaaacatcttgttcagacgctgcatcatgttcagcgcggcagttgttgaagcaacaacatcgcgacgcgcgtcataattgcgtgtctgtttcaaaccataattgcgccccgtgctcggaatgatctgccagatgcccgcggcattggcgccagacgttgcgtgaggatcaaaagcgctctccactatgggtagtagtaccagttccataggcatgttacgttttttaacttgcccggctatccagtacatatacggctctgcccgtaaagttacatcgtggagatagctcttattgcgtaaatatttctgtttctgttcgcgaatccggtcgttttccggaattcccatctttagctcgtcgccaatgaaagcccacaagtcaccatctagcgcgatagacgtcccatcgtccatccatcgtgcctgacttgtaaactttgctgcttccccttgaccagctgcagaaaggctctgtgcgtgctgttgaacgttgccggtgctctggcaacccacgagcaggacagaggcgagtaatatcgcttttgccttcatgtgtgtgtcaatagttgcttaaaagacgaccgatcataacggcgaacggagccgatgacaagaaagttttatcagaacctatctttctttgaccttaaccatgcaaaacgttcttcaggttgttgcaataatgtttcttcattaattacattaattaaatcaatattttccgttcttaaaaaaacattaatttgccgctcatttttcagaattacgggtagtgttatttgattttttgcccgtaactccttaactttacgataataatcatttatggacaaatcgtgcggaagaatactcaaagcaaacttcatatttgataaggtatattcatgagcacaacataccaatgtatcgtcaggtaacgcacttaactttttaagtgattgatacatttgtgatggtgtcccttcaaacaaccgaccacacccaccagaaaacagcgtgtcgccgcaaaatagataaggtttactgaagtaacagatatgtcctaaagtgtgacccggtgtggcaattacactaaattcatgccccaaaacgaaggcagtttcgccatctttgactacctgtgttgttcccttatcttgtgtctcttgtggtccatacaccacaatttgcggaaacttttccaccagttcttttacgcctccaacgtgatcgtggtgatggtgggtgagaaatatggcctccggttgccagttattggcggaaatggcgtttaatactggctctgcgtccccgggatcgacaatcagacagcgacctgcttcatcattcaaaacccagatgtaattgtcatcaaaggcgggaatactgttaagattcatagattacctctcagtgtgaaacggaaggttgtgatgaaaccggcaagagtccctcaaactgtcgtggctcctgattgctggggcgatttgccctggggagagctttatcgcaaggcgctggagcgtcagctcaacccgtggttcactaaaatgtatggttttcatctgcttaagattggcaatttaagcgcagaaatcaattgcgaagcgtgcgcggtttctcatcaagtgaatgtttctgcgcaaggaatgcccgtccaggtgcaggcggacccacttcatcttccttttgccgataaatccgttgatgtttgtctactggcacatacattgccgtggtgcactgatccgcatcgtttattgcgtgaagccgatcgggtactgattgatgatggctggctggtgattagtggcttcaatcccatcagtttaatgggattacgcaaacttgtgccggtattgcgcaaaacatcgccctataacagccggatgttcactctgatgcggcagctggactggctctctttgttgaattttgaagtgctacacgccagccgtttccacgttctcccgtggaacaaacacggaggaaaactattgaatgcgcatattcctgcgcttggttgcttacaacttattgttgcccggaaacggactattcctttaacgctaaatccgatgaaacagagcaagaacaaaccgcgaattcgccaggcggttggtgccacccggcaatgtcgtaaaccacaggcttaaacttcgacttgatagcctgtatcttccagtgtgggattcattgccgcagcacgagccagttcatcacagcgttcgttttccgggtgtccggcatggcctttaacccattcccatttgatttgatgctgccccagagcagcatcaagacgttgccagagatcgacattttttactggttttttgtctgctgttttccaaccacgttttttccagttatggatccactgggtgataccctggcggacatactggctgtcggtactcaaaatgacttcgcaatgttcttttaacgcctccagcgcgacaatagcggccatcaactccatacggttgttggtggtgcgggtgtagccagcgctaaaggttttctcgcgtccgcgatagcgtaaaatagcgccgtaacccccaggtccaggattacccagacacgaaccatcggtgaaaatttctacctgtttaagcatctctggtagacttcctgtaattgaatcgaactgtaaaacgataagtctgacataaatgaccgctatgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaggtagccgatgagttcatggactatatccgcggcgcggagctggtgatccataacgcagcgttcgatatcggctttatggactacgagttttcgttgcttaagcgcgatattccgaagaccaataccttctgtaaggtcaccgatagccttgcggtggcgaggaaaatgtttcccggtaagcgcaacagcctcgatgcgttatgtgcccgctacgaaatagataacagtaaacgaacgctgcacggggcattactcgatgcccagatccttgcggaagtttatctggcgatgactggtgggcaaacgtcgatggcttttgcgatggaaggagagacacaacagcaacaaggtgaaacaacaattcagcgcattgtgcgtcaggcaagtaagttacgcgttgtttttgcgacagatgaagagcttgcagcacatgaagcccgtctcgatctggtgcagaagaaaggcggaagctgcctctggcgggcataaatacctgtaaaaggcgctaaaaatagcgacttgggcgatttttgcagcaaacgattcaaaagatgagaaaaaccgttgacgaagggtgaggcaatccgtaatattcgcctcgttcccaacggaacacaacgcggagcggtagttcagtcggttagaatacctgcctgtcacgcagggggtcgcgggttcgagtcccgtccgttccgccaaattcactcatgaaaatgagttcagagagccgcaagatttttaattttgcggttttttcatctaaatcccgctatttcttcggtctatgattttgttatgctgtaaatgtgttaatcacatatgatagaccatgtcattaatatttaatcatgctatcgaatcattcaatttaaatatatttgcacgttatgattttcatttttctattgatttaatgaatttatatttgctgttattttttgtttgttctgattcaagtggagtatataattaaaaatcgttagctaaacattaccatgattatgacaggcgagggagtgtccgattatgaatttaaaaaaggtttgttgtatatgtgtattattctcgctgcttgcaggatgtgcctctgaatctcctattgatgaaaaaaagaaaaaaactcaaaccacacaaatttctattaataaaaacgttccccagcaactaacagacaaagatttatatggtaatgaaaccacactggctgtatccgaggaggatattcaagctgcgcttgaaggagatgagtttcgtgtgcctcttaattctcctgtaatacttgttcagtctggcagtcgcgcaccggaaaccattatgcaggaggagatgagaaaatattatacagttgccacattttctggcattcctgacaggaaaaaaactgtaacctgtaataaagacaaaaacaaagatgaaagcctggatattgtagatgccgaaaatatgaactggatgcaggcattgcgttttgttgcagcaaaaggccatcagaaagcgattattgttttccaggatacgttgcagacaggaaaatatgactctggattgaaatcaatagtttggacagattataaaaatcaaaaattgactgacacgatgtcactgcgttatttggttcgattcacgttggtggatgtggctacaggtgagtgggctacctggtcgcctgtgaattatgaatcgaaagtgatttttccgcagatagggaataaaaattctgacagccttgatgtggcagaacagcagatttcacaacttaagcagaaaacgtatgcagcagtggttaaagacctggtgaatcgatatcagtagtgaggttttataccagacgttttagtggtacttagcaagaaagagcatttctcttttctattttacactatggaacaagtctgctaattaattttacatatatcttttaggagtggtaaaaactttcctaaagttatttattgtcctctcaacatataagctgtaattcgagttttcggttgaactgtcaaaaatacatcatatacatctataaaacagcaggtacggttaattaagaatttttattcgtgattaaccgtactttgtcattttatcctataatgttaaattgcctttttaaaatataacaataatgcagatgaaagactccctggtaacttagaaaatccgttcactccaaaggctgtatgcactggttccggcgacgctgtgctcccaattgatgctctcataggtaaatgacacagactcttccgcctgcccaggactgtcgttaatggtatggggaacggtaaggccgatgtttgagagccgggcgttagccagtttcagcttgtagtacggttcattaattccaaagcggttggtgcggtagaatacaaaatcacaggtcagacattcattctctgaaatggccttgcccagcagaggggaggatttgtccaccggtttcgtgatggtcaactcctgatggttgacattctgcgcacggctcagaccatgggacagtgacgtcaccatgatctgatcctgatgtgcaatctgggctttgttaccgatggacggcattgacgagcatccggatgaaatcagcccctgaagttctccgttcagtgtcagatagacgggatttgccattgttattctccttaatctcaatgagttggatggacaggttcggttctgttatccgttgccatatcctgtccggtatttttcagcagcagccagcggcttaacagcccgtccagccgttcgttgatctctttttccaacgcctgtgtgtcctgcttctgtgtacgggtctcctggtactgcgtcagcaggtactacagtggtgtttcttgattcagtaaccgttcggcctgccaggtcaccgttttgatatacgatagggtgaaaccctgtttctccgtctccttcttcatcatcaaatctgcaaaatcccgcaaattctgccgcgcttgttgccagcccttcatctgcggactggcttgcgcccggtttctcagcgtgttgctccacatcctgctggcttcctgctgttgcaggctttccggccagagggtgtctgcggtgcgcatcatctgcattccggtttccagcggctgtagtggcggggcattcagaagctgttgcaggtactgttcatattctttcagtaccggggatgccaaccagacggtggcggctccctgtgtggtatccctgacctgtgtaagctgctgctgcatcggatacgcctgccaccaccagagtgcagatgcgataacggcagtacaggcggcaccggcaacaaaaccttttaccgtgtcgccctgttttgctttgtcggcgttatctgccacaccgcgcacccccacccgcatttccggcaggtcgggtaggggggcatggtttccgctgtggcggaagccgtgccttcaggcgcatagaccagcgttctgaccatggtctgtgccgccgtatcagtacggtttctgggctgcggctcaaaccgcttgcgtgtgttctgcacaaaataaagcagattttccacgcgcggctggcgcttcagttccacttgctggagtttgtcgcagataagctgcaaagcccgttccgtgcggtagagcaacgaaagatcattttcggaaaaggaaacctgctggcgcaggatattcccggtgcgggtgttgaaccagtccagcatctcagtccgcgccggaccactctgtggccagaatttatcccattcgtggatgatcatcgcagccagcagttccgcgccttcacagaaccctgccagtccctgattacgtgtacgtgccagcgtatagtaggtggcggtatgcaaatccaccccgttggccttaaaaatcgacagcgccagcgattccaccagtttccagttcagctccggctgtgacgggtggttagctttgttaatttcttcgcggatggcgctgaactccggcagggcgcgcggatcgctgccggtaacgatagtttgtgtcagtgcgtaattgctcatcactatccccttaatacaacgtatccggtaaacggaacaggctgaacagaccgccggtgaacgggttatcttcggtatccacatgcacctggtaaaccattgcgccgccgtccacgttaaagcgcacgttaaaggtgtcactggtcacattggtcaactggcccgcgccgaacaggcggaactgcgcccacggtccactgaacgcgatactgcgcggtgctctgccgctggtgccaatcagcgtcagcttgctttcattgccttcacgcatgttgttcggccagaccagatgggcggtgtagttgcgtccctggctgtagtccactaactggccgtccaggttaagtacgctgcgccgcttattgccggaaagcgatacggtttccacggcaaactgtgcgcccagcccgttctgctggctgaagaagatgtcgcggattttctgcgcggtatccagttgctgccggatatcttcacggattaacactctgccgtcgtcgccaaaggtcagatcgttttcaaggaacaggcgcaggttgttcttgtagaaattgtccagaatgccatccggtttaaagaaacgttcaaacgaatccagtgaggcatcctgtgtggcgcgcggattaaacggatagttatcggcaagctgctcgttgaagggtttcactacattgtcgcgccagtccacttccatgtaacgaacggcttccaccatcaccacatgccaggcctgatccgcgagcttacctacccagcggttaagaggcgcaggcagggtttttgccatctgacgggtggcgaagattggatcgctgctgttttgatccagccgtagctgtactgctttcagcgccgatttccccggcactggcgagttctggatcgccagcaggtaacggtgcagctcggtcagttgctggtacacggcctgtagcgtactcgccttgtccttttgctcctccagtgcgctgttttccggtgcgaactcatgccccagccgggataacaggcggtaatccatctcatttatcgccgcttccctcgccttatcatccagtttgccggagagcgtcagcgcgtgggtattatcgcgcagcgccgtcagcgcacgctggaatggctgatcgccgctgataatctgctccagcgcgtcggtcagcgccgacatggcctcatagtcacggacgttgaggttatccattccggcacgccaggtggcggtatagtcactgatgtactgttcggtgatatggcgctggatctcttcacggtcggcctcgctgtaggcgacgctttgcgtcaggttcagtacccacgaatccagcgcggtcagctcaacgaggccctcacgctgtttgacaaaatagctttgcagtccatagcgggtgaggaactgcgggatcaccagtttttcatcattaccggcgacgaacacgttgtcgaaggtgggaccaacctggtcgcgcaaattcaaatcggcgggcaacacgcttaatgctttggtgcgcagggtctggtagacacgctggtatatgggcagcttgctcagttcctgctgcgcattaatgatcggtttatcatagggggtccagcggctgacagcatcgctgtcgctgctttggcgctgcgcgtgccagtcggtgtgctccagcgcatagtccagatgcaccatcagttgcgcctgaatatcgcgctggccgtgaaattcattgctccagcgccgtgccatgtactgttttaccgcctcgttgttgcgcccacttttgtcttccatcatgcgcactacgcgcagcacagcgagcttttcttcgctctctggcggggcaatgtttagatcccggatcaggccgttcattaacgaggggagataacgctgctcaagaagctgaatgtaggtttgctccacatacggccctacgcgggcgccctggtacaatcccatatccgccagaaaaccgtgatcgcgataatcaccataggccagggtggcatcgcgtaccgggttaagcaatggcaattgcagattgccgaattcatccgttccctgcggtggtggtacgtccataaaggctttagcttgtgccagtacgttaacgccagactgccagttctgattgtaataatggtgccagcttccgaccatcaatgccgccagtgccgcgccacaggtggaaaaggcggtcagcctgcgccgggagctgttcagccagacgctgttttcacccgccaggttcggctcagccagcaggacttccgggaagaggcggcgagtaaaatacggcgtcgtctccaccagaggccaggttgccagcgagctgttacccagtccgtactggcgggcggcggactgcgtgaaaatatcatccacctggccacgctgtagcgaggatgtgagccagacgccacgcagcattacatccatgttctcaccgtccagcaatgcggcgagcagtgcggtgacgatttctcctgttccctgcatctgacgggagaagctgaacacagcgctgcggggagcagcaccggtttgtgcgagcaccagatccgacagcgccaggttcacctgttgtacccacgtctgccagaaagcccccagttcgctgcgccagccgtcactttcatgggcgcggcgggtaaatgtgacgccgaggatcgcatcgcggtcttttttatccagtgaatggaacagcgcggcaaagccgttcagcagatccagccgtgtcagcaccacgtaaacgggcagacggcagtgcaggctctgacggatctcctgaagttgctggcgcaaattttgtaccagtgtctcacggcgggatttatccgccgtcagcagatcgggaagatcgagcgtcaggataagaccgttgagcggctggcgagcgcgcgtttgcatcagccagctcagccagtgttcgcgcaggcggcggcggagcagatcatccccgccgggagtggtcagtacgccgtcaacatcgaaaattaccgcctggttgcccactcgcggtgtgatcagcgggtggtattccacaccccggatgctttccggcgtgtaaacaatgtcagacggaaagccctcgcgcagcagcgtgcttttgccgctacccgcaggaccaatgaccatataccacggcaactgccacagataacggcggttatccagatggcggcgcaggcgcagcagccagtgatccagatattgctgctggcggtggagttccacggtcaacggatctttttcttcctcccgctgctgtttctgctgtttttccagcttttgcagacgcttcatcacccgccaggtgagccagaccagagcgataagtccccagacggcggtcgccagccagcggtttgccagcggagccagccagtgctgctcatagatcgtccattttggaccctgccaccagatccacaccagcagaaaaatccatgccagcgtcagtagccaggtggcggaaactttaaaccgcggcatcgctggcctgagcgcagatttcaacgtgctgaacagtcgggatgtgggaaatttgaacacagtaactccttgttatcttttactgttctgccgtgagtttttgttccagtgctttcagcagggaaggctcccattcggatagcatcatgtgtaatcctgttctgaagagcatccggtactgctgttgtgcaagctgaaccataccggcctcttccagtaactgcgcgccgaaaaactggcggtgaaactggtggcggggatcaccttcgggcaggttttccaggtaccgcagcgcggcttccagcccgttttcatcgaagcacgccttggccgcctgtaattcttcatcggtctgtacaaccgggacggtctggttgactgagccggatgatgccagccactgtttcgtctgttcggacacaaacggagtgcggtcgttaaacaacaggttgatcagtgcgggcaggcgggccagaaaatcggtaacttcatcacggatagcatccgccacctgtttataaccgaggcgcagcgcggtctgtgctgagaggtaatgaccgtccagccagtacggggccagcagcaggcttttttccacctgctgccacagcgccatgtcggcattgttcagccgcgccaggtaatcatccatcatatcgacagggaaggctgccagtggggtccggccatcgctttctgcctgcggggtactggtgatggtttgccacagcgcatggcggcgcagtcggtaaccctgcggtgactccggctggcgctcacagagaatggcggccacctttagcagggtgtcgcgccatgctttatcgtcgtggttttcaacggtgacctgcgggattggagtggctgcaacaggaggctgagcggcaaccgtgtgcggtgacatatccggtacatatccggtcgtggcctgcggcgcaatggcggcgcttcgtgcagatgatgtcatttcaggcgctacatcacgaaacgcgcgctgaaacagggaaaataaatcgtctgtcgcctttgccagctcagacgcgttgtgcgcctgccagcactgtgccagttttgccagctctcccagcaaagcatcgcgctgtattgtcgcagcattcccggcaaagtcctgaacggcagactcaaagcgttttatcacctgggcggcaaagcgttttttgtgggccatgttctgcggtgcggcgcatgtccagtagtgctctgtatattgtgccagcatcctggaggccagcagaatatcaccggcatgttgcagggtacgcagcaagtgggccagcaggcgaaaatctttggtttctgaggccagaagcatcaggccccggcgctgaagttccgggatatcaagctggctgtgcgccagtgaaccgagcttgacgatttcgctgtcgacaaactcccagtctgcattgccatcatcaagcgcggcggacagcttatcttctggcaggttttccagcaggtgtgcaagccatacatcgggattacgtaagtccattgccatattcttattctcccgcccagtggcaggcgtcgcgtagcggcgcaataacccgtgccagcccgtcaatgttaaaggtcagctttccggcggcgttgtctgtgccggtatccaccgtcagcgtttttgcgccgaacagttgcttaatttcatcgataccggataacccccggctggactccagcagggtgccgttctcgcgcacaaaccagtggctgcgcaatgctcggctgtcggcattcagggtgacggcgatatcatggacatccagagggtgcatcagcgccacctgcatccgggtgatattgtccacgcaactgaacatcagcaccgggcgtggcggaacatggccgatagccggggtggttatcaccaccgtcgggcgttcacccggtacttgcgttaccagcagctccgtggtgttgccctggcggcgtttttcctgttctgtcgcgcgggcccaggcttcaccctggtaacgagctttcaccagtgcggcaccaccaaagccagcctgttccggcgcaagaatgcggtcataacagtcaagccgctccagcgccgccgtctcctggcggcaggactgcatggcctgtaacgtggctgtcgcatccggcggtgtcgctgtggcgacagctaccgccacaccggccactgacgatgtttctgtgggcgcggcactggcgggtaagcccgccatcaggcccgcgataaaccatcctgtctgccggaaaacgcacaacctgctcataaaaccgtttcgtcctctgtttgcggtgtcacggcatcatcaggcagcgcatcttccacatctgccgtgaacgcaccgtctgccgccgacaggcgaatccgggcaatcgccgtgttggccgccattttctgcaacagcagcagcgagagcggcggcagcatgtcgccgtcgataaccgattccagcatcctcgcgccgttttccgcgcgggtgacgcggctcatgatttcgtccgtcacttccggcccaataatcacgtccgcgccaaagcggctgcgcagcacgttatccaggcgggccagtttcccggcaataatggtagcgagcgtctctttcgacagcggtaggtaaggcaccacttccatgcgcgccagcagagcaggtttaaagaagtccgccagcaccggatagagggcttcctgcatggtttccgggtcatcggcgtgttcgacaatcacctggtagccaaggttggaggtcaggaagaaaacgatatttttacagtcaatcaggcggccttcaccgtctgccatctcgcccttgtcaaacgcctggtagaacaggttgagtacatccgggtgcgctttttctacttcatcgagcagcaccaccgagtacggtttctggcgaatcgcttcggtcagtacgccgccttcaccgtagccgacataacccggaggagagccaatcagccgcgaaacggtgtgtttctcctggaactcagacatattgatggtggtcaggtattgacgtccgccatagagcagttccgccagttgcaggacggtttcggttttacccacgccgctggggccagccagcaggaacgcaccaagcgggcgtcccggacggcgcaggtcggcgcgtgcggtcagcaggtgtttatgcaggctggcaatcgccaggtcctggcccttgatggtgccgccgagccataccggcaggtcggtgatgaccgacatctcattctgtgacaggcggttaagcggcacgccggtccattcagcaatcaccgctgcaatctgttttttatcgacatgcggggaaaccagcaactggtcgttatgcagggcgtccagttcggcagtgagttgtgccagccgttgtaccggggaaactgtttcagtggtctcttccggctgtacgctgcctgcatcatcagccgattcggcatcggtactatcctgttctgcctctggcggcgtatcctccacggcatctgcgtccggcaacgacgcaacgtcgtcttctgccacgcccagtaactgctggcgcagcgcgataatttcctgtaccagcgtctgctgctgctgccaggcgacttccagttcgtccagcgccgacagcgtttcatcatactgctccaacacctcagtcattcgtgaggtgtcggtacgcagcccgatgcgaagctcgcgctcaagctggcgaatttctgcctcctgctggtggctcagggtggtcagtgccgagatttgttttggcggcgatgacaggttgatggccacacgggcgcaggcggtgtccagcacatcaatggctttgtccggcaactgacgcccggagagataacgctcgctcagtgtcgcagcggcctgcaaggcgtcatcatcaatcagcacgccgtgagattgttcatagaccgccgacaaaccgcgcagaataatggtggcttcggcagcgttgggttcgctgaccttcactaactggaagcggcgcgacaaagctgcatctttctcgaaatattttttgtactcgctccaggtggtggcggcgatggttttcagctcgccgcgcgccagcgctggtttgagcaggttggatatatccagcccgccctgctggttgcccgcgccaatcagggtatgtgcttcgtcgataaacagaatgaccggcaccggggagaaaatgacctccgccatcagccccttgaagcgtttttcaaactcacctttcaccgacgcaccggcctgcaatgcgcccaggtcaagggtcatgatatcggtgtttttcagcttgtccggcacctggcctgccacgatgcgcagcgccagcccttcaatcagcgcgcttttacccacgcctgcttcgcccactaccaccggattgtttttacggcggcggcagagaatgtcgatcatcaggtcgatttcatagttgcggcacagtaccgggtcaagcctgccgttacgggcgtctgcggtcatgtttttggcgtagcgggcaagcagggtgtcgccggtttccgttgcgcggggcgtttgcccgccagccagatccacggattcggcggattcttttgtccatgctgcgaaatcctgctgtaactggtcgcggtttatggccgtcagcagacgggcagcagcgggtggaatatagcgcagcggtgaatgcagcagagtaagcagcaggacgccgctgcgcagttcgctgtgctgcatctgggctgaggccagcagccatgactccttgagccattcgatcagcatcggggagaagctgggatagccttcggcggaacgtccaccgggataactctccacggtcagcgcctggcgtaaatcctccgcactgatgcctgtgcgttcggcaatcacccttacgtcgttgcgcgggattgccagcatctgtaacagcacatgggcaacggtgatctcactggcctgctggctcatacactccgaggcagccatttccagcgcctgttttgcaaaggggttaagccgctttacgagcgtggctaaatcaatctggatcataagatgtccttatcggagtaatttattgagctgatgcagaatatcctgtgtctggctgtccagacgcagcagataaaacagataaaatacggtcagcacaacaagaccgccgcacagtacatgcttgatggtcagtcgtcggattaactgataacgcccaccctgtatgttgttcttctgatgaagtagcggaaatggcgcgtcaccgcgcagtttgtgcagggcatggtgcaggcgctggtagatccgctcaaattcatcctgttgctgaatggcaaccttgtagcgcccgcgaaagccgagcgaaaaacagaggtataaaaattccagcagatcctggtaacgtaccggctcccggatcaggcgttcgagcaggataaacactttctcgccgccccaggcttcgttatgaaaatgaaccagcagcgactgtttgatccattcgtttttgttggaccagccgttgcccagcgccgcttcatcaataaacgtgcagagaatgtaacggaacgaaacaatgacgcccggttcgtatccctgttcctggagtagttgctctacggcctggacatcggttactacctgggtaaacagatgttccggcatggcctgactgttcatagtggacagacgcatcaccatgccgagcaacggcgtggcggcgtcaatcattggattcaggctgttgccgcgaagggcgagacggtactggcgtcctggtgttccgctctccggctccacgggaaaaaccgacgcttcactcatatcgctcattcacttatccccttatagcccagagctggaggttcagatcggggaagctgccggagatatgcagcgccagtgcgcccgcttttatcacgtcctgccaggccggggtgcctttttccagttcgaagtaaacataaccttcgtggtatggcaactgacgtggcgcagcggtaagcgtgtgcagcggaatacccggcacctgcacgctgaccacgctgcggattttgtcggtagcggccactttcgactgctggatgaactggcgttgtacctggtcgtagggcatcctggcgcgcactgccagtaccagcttgcaggactgcaacaatgtgggatcgttgatggtggcgatccaggtcccctctgaaaagaacaacggcagattctgcgcacgcggcaccagtacggtattgagcgcgcgccgcagttccgggatcacggttctggtgaaggtcgcggtaagatcccggtgattatacggctccacggtgcagggcaggcgattaccttcggtaaaggtcatcagttctcccagcagccccaccagatcccggtagaaggcttccggatgcagcgtgtgcagttgggaacgatgcgtgaactgcatttgatagcggttaagcatctgcaacatcataaattcggccacatcggcgatcccgctctgttcaggcgaaccaatgcgcccggccaggtcagcggcgcgggtggcaagcagtccctgcacctcgccggagaatgccccgagcaacccgctgacacggacggcctgaatggtgggaataaaggtgttgtccagcaccagcgcgccggtggcatttttattgaggatacggcacagggggagagtcaccatcgcgctgagatcatctgcgccgctgactatcctggggatcaactgccccagaccgactggctgttcgtcgccttcgtcagtgtgaaaatcacggacgcgggtatgggtgaggcggtaacgctccgtaccctgaccggcgctgtgcaacccctggatttcattgatcacgtcgcttatcaccggcagcgccagataaatattgtggctctctttcgatgaaagggttcccggctggaaaggttccggcagcagatcctggtcgggaatgctgaatacggtgccgtcaggcatacagcccgccgcacggtcaatcatgattttgccctgggcaagcagttctgtattgatggagagttccgtaaaaccccagaaaaaatcacccagtgcatccagacgacgggtcagcaggtactcgcagtgacgctgctgttgctgaaaatgctgcggcagggcaaacagcccttcctgccagatcactttgtttttcattgttgccatcgtcagttttcctcttttttcatctcaatcgcactggcgcggatatgcaccagcaggcgatagtggtggccgatactttctaccgactcaatttgtttccattctgtggcctggtcgtccgaaaaataggcaatgacaccgatataaccggttttctcatccaacttgatcggcggcagtgtttttacggtatccggcaacaggttgaagtcctggtgatcgatatagtttttccccagcacgtcgggcagcgcggtggtggcaacctggtcgtagtcggcggcatggaattttgagtcgtcgctcagataaaccaactggacatccaccggagcggcttcgccatccgccgtcaggttgctgtccggctcggtcagcagcgtgacggtcagctcggttgactgatccatcagctttccgacctgaatatccggattgcggatcacctggctgatttttttcgctgtttcacagccagttaatacgacgctcatcagaacgcaggccagaaacgctttgccgttcatgcttccggctcccgctgtttttcgcgcagcacccggtcatagacctgggcataaacttcattgaacagcatttcaaatccctgctgtcggctggagcccagctcatcgtaatagttgctgtacatctgccatgcccaggcgtcgtccattttctggcgcagttcatggctgcggcggtattgcgcaaagcggcgcatcaggttgcccggcgaaaaggcgtccagcatgacacgcaacgcttccacaatcgccgcccggttagcctcttcatgatgccggatgttgcgcaggctttcggcgatggccgcaggtgctgcgagatgtaccgggcttttaccctcggcgaacatgacgttcagcgcggtggcatagtccatatcaaggcgcaacgggttgtcttctagtggacgcaggtgtttatccgacaggctgttctgttgttgttgcagactcagcaatcccttaatggcggcctgcaacgcccgtccggcctcttcgagaaactcatccgcatcctgagaattgtgcagcgtcagcggacactccataccgcgcagcagcggggttacggccaggtggtactgcgccatggcagaaaattcatcgccgtcctcatgacgggcattgccgggcggcagatccataaacggcgtgttgatcccgtttgcacctgtcagatcggatgcgggggctacgggccgggaaacgcgtggggcgatcggatcatctgccaccatcaggctttccgtctggagtgcctggagcggatcgctggaaaaaccgtgcgccaccgtgggggcaagctgatgctggaacggcattcccggatacgccggttgtccctcggtggtcagcagggtgtccgccagactgtcgcggttcattacaatcgtttccggggtcgccatccgctcgtcataggtaacagctgcaccgtcatgcagaaacactttcagcgccagtgcgccgagctggatctcatccccctggcgcaggcggatgagcgcatcggaagaggccggggccagattaatcatcagtcccggcgtcaggcaccgcaggcaataggctccgtcgtgccggataacggtacaggcacgcgcagcaatgcttcccgcccggtcctgtacctgccagtgacattccggcgtatggccaatatcaccgccgttttcgctgaacaggcattttgcggcgcgtccgctttccagttcgttgccattcatcacctgtaaagtcagtgaggcctggcgggattgctgtttttcctcagccataagtggttccatagaattattccctgattcggattgtgatggcgggcggtactttcggctgaccaataaagctggttctgccgaggcgggagctggccggatcgccaaggcgcatccctttagcctgctgtggcgccaggcacagccgtaaatcccaggcaaactggtcgcgcagaataaaggaaaggaacatggtcagcggcaggtgattttcgccatcgggtaaaaatgagagataacgctcccgcgacaggccgccaatctgcaacaggaattttccgctgcgatccggcacccgtgcgccgagggtaaaattaacgccgagtatggagcgtcccggaatatgtccagccgtttttcctttcggattacgtacacccagccggttctggtgtgccggatcaatggcgactttacgcagttgccagcgttcaatggtgacatccggcaaatcaaaacagtgcgacaccagattacagataacctccggcgcgcggcctggtgttgccagaattccggcgtaggccagcattttgctgtggttaatggcaagcctgtcacgcacgctctgattacccagcccgaccagtgcgtacatgcgctgtgaaaaggtgtcagtaccgccgctacgaaagcagatgtagtagcggtatttgcgccaggcatgataggcaaactgtgtccagcggtggctgaatagatcgagaaattctttcaggccgtcttcgttctgtgcggactcctgcgccatctgatccagataatagcccggtagcggcgactggctgccggaaaaacccaggaaccgggtttgcagtacatactgtccgttctggctacgggaaagcgcactcaggtccgtacccggaaaactgatactggcgtcagagctgaaacgcacgatctcccgggcaggctcggtacgcagggaaatgtcctggcccggcgcgccatgccgacggtacagcgcctccatcagcacatagaaattgcagttgcgcacatccgccggtaacggcggttttgtcgctatatcagggcgtgctggcccattttctcctgccattcccaggactcctgactttccgtgttaatgattttcagacagtggtacgaattgatgctggcgtagagggcaaagaagtgcgagagcacggtacccagaagataaatttcaccttcgcagataaacggatcgggacgtatccacagcgtggtcgccagcccgcgaaccggtacgcctttaaacaacctgtcaacaggtttggtttcgagtttttctatggcatccagtttctggcgtgacagtctggcccgctgcggatggtgagcacctggcaggtcgaaggtccgcaggatctggatcagtgtctccctgtccagcagggagaggtagttcaggttcatcgcggaaatcagcgaccagtgcatgtcgccgtccgtgactggccagagcggcagtgtcgggcgcgtgacattacgaaatgaggccactgccggatttttgttgacggccacgcagatatcaccggtatgcagccgggcagggatcatacggttggtacagattaatgacgtggtgatcacgtcatcgttaaaccgtgagctgcccggaatgctaccgtctgcatggacaaaggcgatagagtgttcaagcccgtggtgaagcagggacgttttagtccggtgatgccagtagacgacttctctctggcggctgtactccatctggtgctggaagctttcaaattcgggccagacacgcgcctggctacctgggctgatttcagtacctgaaaatttgactttactggtgactgtgctgacctgaaaaatgtcataggcgtccggatgcttatggctggcgcgcagcgggtattccgccatccgcccatccggcctgacgggttccgcataatgcgtaaacaggttaatggctggcgtacagtgcagacgcagcgaatcctggcgcagcttgatgtcggcaggtaacgggcggttaaagtgcaggcgcagcgtaaacgcattgatcgggaaatcgtctggtagcggcgcaacatcgcgcagatggaaaaagaagaaggcttcgggatagcagaaatactcctgaagcacgcggtagccgctgtggacatttttcggccacggcagcagagcatcccggttgtcaaaacccgccgcctccagccacagatccggcagcggcaggcggtactctccggcaatcagttccgcatccatcaggcattcgcaaaaccacagataaagctggtgtcgggtataatcgtcttcattacccagccagaacgtgattttgttcaggtcaagcatggcgggggagacattgttatctgcggtaaaactgatatctatgatgccttctttcaggctgctggcgttgcgggtatcgagaatgcgcagtggttgcagccagatatcgcgcgccagcgtgaaatggcaggctacggaagaaacgattttatcatgattgtcaggcagcaccttctgagcagtcagggaggacttttctgagcggcttctgatcagttcattacgacagacctgaacagggacttttaactgatcggttttgggttcataggcaataaccgtcatggccggaaccgggcgtaaatagtttgcccacagcatacggatcagcccatgggtgaactcggggaattcgtcctcaagtttctggcgcaggctaccggacataaaggcaaaggcttccatcagacgctccacgtccggatcaccctctttctcggccagaaagtgggccagatgtggtttttcctgcgccagcagtttgcctagctggcgaagataatccagctcttcgcggtagtaacgttcttcaaaagccacagagatcactccacacaatagcgttgatggttgtccagcaaaatgtcaaattcaaacactcccctggtttcgctgacatcgaccgtagccacaatatgaaaacacagttccacaggggcgtattcatctggtgcagcagccgtaacaacaacatcggtaatacgaggttcgtaatgtaaaatgcactggctaatggacttacggatttctcgtctgaaatcgctggaggccagcgattcatcatttaaatcagtaatccccagctccggtgaaccataacaactgccggagcgggtattcaggacctgtcgcaggttacgtctgatggaacgtatcagtgcttcttttggattctgatatgaaggcggatttgccgcctcacggatacgttcaaaaagactgccggttggtcctgaatcccgtcttagcatcggattattccttatccagtcgtccgaccaggctcaggtcgaaactggcacccatgtatttaaaatgcggtctgacagaaatcgcgacctggtaccagcccggctcaccatccacatccagtacctcgatcttagcctgacgcaaaggccggtggctgcggacttcggcaggcggattttcctggtcagcaacatactggcgaatccaggtgttcagctcacgctccaggtcactacgttctttccatgagccaagctgttcgcgctgaattaccttgatgtaatgcgctaacctgctgataacaaacaagtatggcagctgggtgccgagtttatagttggtctccgcagccttgccttcgggggttttggggaatgttttgggtttctgcaccgagttggccgagaaaaagcacgcattatcagaccctttacgcatggtcagtgtgataaagccctcttccgccagctcatactctctccggtcagtgatcaacacttcagtcggaatttttgcctgcatttgccccatggattcatacagatgcaccgggaggtctttgactgcgccgccgctggaagggccaataatatttgggcaccagcgatacttagcaaaactttccgccaggttggcggccagtaaaaacgaggtattcccccacagataagactcatgactctggctgacatcttcatggtaacggaaggttttgacagggttttcatccggtgagtaagggtggcgcagcaggaaccggggggcggtcaggccctggtaacgggaatcttccgattcacgcagggcgcgccagcgggagtaggccgggccttcaaagatggcacccggttctttgatccccggtaactctgtccatgaatccagaccgaaaaattcggatgatactgacgacaggaacgggctgtgcgccatcgcgctgacctggctgatatatttcagcagcttcatatccggcgtggtgttcttaaaggcaaagttgccgattaccgccgccactggctcaccgccaaattgtccgtaaccgcttgaatatacatgcttgtaatatgcagactgcgtgatttcaggtgcaaattcgaaatcatccagcagttcttcctgagtgacattcaggaaatggactttgatgttttcccgtgtatccgcgcgttcaaccagcagcttcagcgagcgcagcagggattccagttcctgaaactccggggcatgaataatggcatccatctgcctgctggttcgggcatcaatatcagcaatcatggcgtcaacggccaggatattgataggttcagcgctactgtcgccctgtaacatggcggcaataaaggcgctcacgccctggcgggtgatatcgtagctttctgatttaggctggacgcgggtttgcgccatgatttcatcaagcagagatgggggcgcggcggtttgagacgcgctgacgggagcaatttcttcctttactgacatactgaatatccttctgtgaaaattatttctgaacggcgatacccagttcctggatcagctgctcgcgggtgtcttcgttttccagtagcgcctgaagttgtgcgcggaaggctggaatattgcctagtggagacttaagtgcgaccagggcttcacgcaattcgagcagacgttttatttctggtacctggctggcaatatggtcaggagaaaggtcatccatagatttgactttcaggttgacgtacatttgctcattgggagcgtcactgagttcagccggaacaacaaactcccgttcaatgtcagcttctgaaatgactgcgttgaggttatagcggttgatagcaatggcagttcgctcatccaacggcgtgttatctggtttccctttcagattgccggtgatcaataaattcagcggcaattcgatatcagcagccaccccatcaacttttggtgtataccgaacgctgattctttctttcggcgcgacactgccgccattgttgttcattttgctcataaaaatgttcccgttcaggccatgagcacagcattttcgtactgcatacaaataccgacaataccgtttcagtggcagttagataatgtaaccttccttctgttgtgatcggtattctactcatgaaataaaatattaaaagaactatttatatttttgaaagagatgtatccttcattattaatacatgagagttaaatcaatttggtatttatagacttagtgaatatgattttacggctaataaagttacataatgcattgatttatatgtgtttattaaattgattaataagttttatgtatggttttataaataaataaattaattaattgctagaaatacatcataagaaattcctttaaggaatatcttaattgcgtgccggaacgattgtgaagtaagtgttgtaatgattgatttttgaagaaattgtaggtttttatgggggtaaggatacgttatggataattctactgttgatgttgatatatttttagcttatgtgatcgtgttctgaaattgactaaaaatatatttaaacaccataaaagagtttttcggtaggtgctaattacgtgtgcctgtaactcgaataaagaaaagggtgtggttcctgatgtgagccgcatcacactctaacctgtcggggattaacgacgggttgttcgtaaaacagcagttgataatttcacaaggagttcataaatgccaaccccatgttacatttcaattacaggtcagacccaggggaacatcactgccggtgctttcaccgcagattctgtcggcaatatctacgtgcagggacacgaagatgaaatgctggtgcaggagtttctgcataacgttactgttccaaccgatccgcagtctggtcagccttccgggcagcgtgctcacaaaccgttcattttcaccgtggcgctgaacaaagccgttccgctgctgtacaacgcgctggcctccggtgaaatgctgccgaaagtggagctgcactggtggcgtacctctgttgaaggcaagcaggagcactacttcaccacacgtcttactgacgcgacgattgtggacatgaacctgcatatgccgcactgccaggaccctgcacagcgtgagtttacgcaattgctcgcagtatcactggcctaccgtaaggttgagtgggagcacatcaaattcggtacttctggtgccgatgactggcgtgcaccgctggaagcataaatctgagtcaacaacatcctgcctccgtgcaggatgttgtttttgtacgtgtaaaaaatgagtgtcagtaaggagttacgctttcatgagggagatggtggatgccggaaacccgggcggtagcgtacctgaaaatgtaaagatgagtgtaacgctgcactggcaccctttgctgcatggtgggaatcatttggtccgtgaatgaatcagggaggtcattatgtccttaaaaggtcttcgctttacgctggaggttgacggccaggagccggacacctttgcagtggtgaatttcaggttaatccagaaccagtcttatccgtttgtgatgagtgtggatgtcgccagcgattcttttatgcagacggcggagatgctgctggagaagaaggcaacgctaaccatctggcagggcgtcatcccgcagcgttatgtcacaggcgtggtggcgggctttggcatgcaggagaacaatggctggcagatgcgttaccacctgtgtattgagccgccgttatggcggtgcgggctgcggcagaacttccgcatcttccagcagcaggatatccggacgatatcggccacgttactgaacgagaacggcgtcacggagtggacgccgctgttttatgaggaccatccggcgcgggagttctgtgtccagtacggggaaagcgacctggcgtttctggcgcggctgtgggcggaggaggggattttcttctttgagcggtttgcggcggacagtccggagcagaagctgacgctgtgcgacgatgtggcggggctgtcacaggcgggagagtttccgtttaacccggacacatcggcaggagcggagacggagtgtgtcagtatgttccgttatgaggcgcatgtccgcccgtcatcggtgcagagccaggattacacgtttaaggtgccggactggccggggatgtatgagcagcagggtgagagcctgaacggacagcttgaacagtatgaaatatttgattatccgggaaggtacaaggatgaacagcacggcaaggatttcacgctgtaccggatggagagcctgcgcagtgatgcggaaaaggccacagggcagagtaattcgccgaagctgtggccggggacgcggtttacgctgacggagcatccgcagaagatgctgaatcgtgaatggcaggtggtacagagcattctgtcaggagaccagccgcaggcgcttcatggcagccaggggagaggaaccacgctgggaaatcagttagaggtgataccggcggaccggacctggcgtccacgggtgcagagcaaaccgaaggtggacgggccgcagagtgcgatagtgacggggccagcgggagaggagattttctgcgacgaacatggtcgggtacgggtgaagtttcactgggaccgttatcacgggatgacggaggagagttcgtgctgggtgagggtgtcacaggcgtgggcggggccggggttcggtaacctggcgataccgcgtgtgggtcaggaagtgatagtggacttcctgaacggggacccggaccagccggtggtcatgggcaggacgtaccatgaggacaaccgttcaccaggggacctgccggggacgaagacgcagatgacgatacggtcgaagacctataaaggaagcgggtttaacgagctgcgctttgaggatgcgacggataaggaacaggtctatatccacgcgcagaagaacatggacacggaggtacttaacgaccggacgacggacgttaagcatgaccacacggaaaccattggtaacgaccagaagataacggtggggttgggccagacggtgaatgtggggagcaaaaaggaaggtggtcatgaccagaaagtgatagtggcgaacgaccggtgcatcacggtacgtaacgaccagatgctgaaggtgacgaacgaccggacggtgagcgtgagtcacgatgacagtctgtatgtcagaaatgaccgctgggtgacggtgaaagggaagctggagcacaggacgacggggaaccatatcagccaggtggaggggaagcacagcctggaggtgaaaggcgacctagcgaggaagattagcggtgcgctgggaatgaaggtccgggatgaaatcgtactggagagtggcggtaaaatcaccatgaaagtgggtggttcgtttgtggtcatccattcagggggcgtggacatcgtcgggccgaaaatcaatctcaatagcggcggtagtccgggagcgccggtgccgacgctgcaaccggcggttctgaaagcgctggcagatgataaaagtttagcggctgagcaaaatgatagtaatgcatcgtccgatcagaatgataacaacgatgagggtgaggaagcgccagaaaaatcggtgtgtaaggagtgcctgaaaagggcgcaggaagcagccgccgcttttgcgcctcgtggataagggagaaagacaatgataacagtatcgccacacgctaccgatcaagacaaatatattatctggctgaagcaggctgaatcattctgttctgccgctggtttggattacatagatgtgcttgttgaccaggctggaacagaccaacctttgcaaaatgagatgcttcatctgtggccagccattcactggtatgccctgtttgaaggaacgcctgaagctgagacgatggagtattcccctgtagtgttacgcctgtactttgcgctcagtagtcatcgcaaatttctggcacaactgatggcgtcatttgctgatacgccgcgtcttactttgttgatatcccctcttacattcgacctgctggggcggcatcttcaggtattgtcacaggttcagtgggaagaacagaccggattgctgcgttactatgataatcgggtgttccctttactgttcacacatgttttgaccaacgagcagcaggcgacatttactgatattgcgttgttctggagctggttagaccgtgatggagagattaactggaaatcaggaagtttttcaccagaacgcaggcttactgacaacccggagatgaatcgggtggatgatgtacaggtgggattgatgggctgtatctgcgacgctgaagccctgatgaaggagaaagcagtcagtgaactcagtcaggaaagctatttttcgcactgtcttgatattgctatcagggccaatgacgcggggatatttcggggctttgcgggacttcgagggataatattgtggtgatgtacaggggtatacacaaaatcattcaagttgcatcaaggcggcaagcgggcgaatccccaggagcgtgcataagtacgtgactggggtgagtgaacgcagccaacgcagagtcagcttgaaggacgatgtgtatatttatctttttaaaattccgtagctgttaatatcaagagataatcgtgaaataaacggaaaatcaagctcgacatgtaatggtagtatccatcatgttgcatttgtgttcgatcgtaatgtcagttcacgtggttgcaatatattttgcgtaatatcatcaatgctctgtcgatatcccaatgtgtgacaatcgaaagatatgtgttttatttgcttctttgtcaaagctttgttgtcgtagaaataataccaattaatcaaaatctcgcaaagtaaaggaaccagcaatatgcccgtcgaaataaagaatggtattggtgtgagagcgatttttaaatatttttcgctaatggttttatttgcagtgtcaggctgttcaatgacgagaaatagcggtgattacactgctggagatattaaaggtatgaaccataccgatgttgctattaattatttcagtatcaatggctatggcggacaaaatatagttccgttcggggagcgggggggtattgttgcgttatgttgccagataagtggcattctggattaaaagcccggattgagtggggaattacaccaaatacagtccctctgccaccactctataaggattgggataaatatcaggcctgggagaaaaaactcaaagaaagttacattcaacataccgcaattgttgatatcccggaatacggtgctgagcgttgtggcatgaccgttcattttctgccatgcaatcagataaaagtgacaacagtctgccaagggtatggtacaccaaattatcccatcaaagaaccccgcgagatgaaggaaccagcaacatgtccatcaaaataaggaaaagtataagtatgagagcgattttcaaatgttattctctaatgattttatttgcagtatcaggctgttcaatggcgagaaatagcggtgattacactgctgtggatattaacgggataaatcatacggataaggctataaattatatacacatcaatggttacggcggaccaaatattggtccattcggggacggtggaggatattgttgcgttatgctgccagataagtggcattctggattaaaagcccgagttgagtgggaggttgatccaaatacagctcctctgcctccaggctataaggacagggagaaatttgaagcatggaagaaagttgcgctaaacagttttagaaaatattcaacaattgttgatatcccggaatatgatgctgagctttgtggcctgaccgttcattttctatcgtgcaatcagataaaagtgacaaccgtctgccagaaatatggcacaccaaattatcctatcaaagaaccccgcgagatgaaggaaccagcaacatgtccagcaaaataagaaatggaatgaatataacaaaagtagttaaaggctgtctggtattaattttgatggtgatttcgggttgctcagcagctaattacgacgattatactgcaggtgatctccgggcaataaatcatattaaaggtatcagtattaattggttcaccgtaaatggttatcgggtccatggtttgggcggtggatattgctgcataatgttaccagagaagtggcattctggattaaaagcccggatcgagtgggaagtagacccgaccccccttgaacctattgcaatgaaaaaagaaggttttggctatgaagaagatgcttatgctaaacatgctgcaaattatcaaaaatataaagtaattgttgatatcccggaatacggcgctgaacgttgtggcctgaccgttcattttctgccgtgtaatcagattaaagtgacaaccgtctgcgagggctatggtacaccgaattatcctatcaaagaaccccgcgagatgaaggaacctgcaacatgtccagcaaaataagtggtctggcttttccgtgttatgcccccccggtgttccctgaagatgggcgattaatattatctgaagcgcaggtaaacgcgaactacctaaaacaaatcaataaaacagaagagcacaaaaccaactgtagtaaacaggctggatttagaattggctttacgtgtaatcaaagtctgcatattagtctgttttttgatggtacaaataataatgaatataatgacactcctggacacccaaccaatattgccaaactgtttcatacgacctatcagaacgcagaagaacagggatattttaactactatataccgggtgtaggcacaccatttcccaagataggtgaaatggattacagcaacagcgggctggagttcgctactggtggtgaagatcgaattaattgggcattattacgcctcgtggatgccctgagctattccattgacccttcccataagcgactggatgataatgtggcaaaagagcacattcctcttatgcgcgctccctggcctatgactggtgaagtgaatcgtcgcaatgtgattaacccctacctggaaaaattacagggactgttagagcaagccagtccgcgcctgctaaacgtaaagctgtttatctacggattttcccgtggcgcagcggaagcacgaacttttgttaactggttgactcagttagcttgcccgcaggagcaacaggtgatgttggccgggttagctgtcagtattgagtttttggggctgctggataccgtagcttctgtgggggcggcgcatgttttaccgggcgctgccggtcatatgggatgggccgatagtactcagcaactccctgatgagaggcagtttcccggcctgattaaatgctgccgccacttcgttgccgcgcatgagcagcggctgtgctttccgctggattcaatccgtcgtccagacggaaattatcctttaaatgcagaggaaattatctatccggggatgcactctgatgtcggtggtggctatcccgttcgcgatcaggggaagtcctgtggtgactcaggcgacattctttctcagatagccctgcatgatatgtatcttgctgcatttgattcaggagcaccacttgctgtttattctaaatttgttactccattaataaaaggtgtgtcgcctctgcgaattatgagtccttctagcgtaaaggaatttacgattgctaattcattaacaaaacgcttcaacatctggcgacaaacgctgctgaacaccactttgcagggcacagaagaaatgattgatacgagggaaggttatcacccctatcaacttgcccaggttcttcagcaaattaaggctatgggagacggactctatccacaattttttattgattcactgggaacgggaacgcgaactcagccctgcgctgaattactggctctctatgatgaccaggttcacgactcccgcgcctggtttatgcaaagttcgctgggtggacgcgaaccctggggcggttattttcgctaccgcatgatttacttcggtgatgaggctaataaagagctgaagctaatctctgcagatggcgaagttgttggcgatcagcccacatccaaccgggtcatttattggatggaatcgaaaacggtgagccgaggttaagttcataagattgaggggttggagaccgggaaaatgtagacatgtagtgcctaatcaccccagttcaaacccatccgcatcccgccatgccggaaacttcactctgtactcccagggaaaggtcaagtaatcagggaaagatcatcaggagtacactttttgtactaaataattcgcattttatgttcaataattgaggtgttccttattacctaaagctgtttttcattgcttatgcatgatcaaatactcattgcataattaaggggggcaaaatggatcttaaaaaattgatggaacatatttctattatccctgattccaggcaagcctggaaagtggaacataaattgccagatattctatctgttaactatttgcgccgttatttttggtgcataaggctgggaagatatagaggatttggggaaacacatccctattttttgaagtgatatggtgattttgaaaatggtattcctgttcacgatatcattgccagagttgtatcctgtatcagtcctgcaaaatttcatgagtgctttattaactggatgcgtgactgccattcctcagatgataaagatgtcatggcaattgatggaaaaacgcttcggcactcttatgacaagagtcgccgcaagggagcgatttatgtcattaaaatccgtcttcatattatttgcgatgtccctgatgaacttattgatttcacgtttgaatggaaagagctgaagaaattatgcatggcagtctcctttcgttcaataataacagaacaaaagaaagagccagaaatgacggacagatattatagcatttctgctgatttaaccgcagagaagttcgccacagcgaaccgaaatcactggtacgtggagaataagctgcactggcatctggacgtggtaatgaataaagacgacttcaaaataataagaggaaatgcagcataattattttcagggatacggaagatcgctattaatattttaacgaaagataagatactcaaggcaggggcaagatgtaagatgtgaaaagcagctgcggacagagactacctcgcgtcagtccttgcgggggcgggctttcgtaatcttgctctgcaagggatgataaaaagtgcaactttattccacgcagctatttagacagcgtacagtaaacaaatgaaagttgttatttcaatggtcagggcaagagcatgaagtgtttactacacactatgctcttgtcctggcgtcaggtcttgtttggagggataaatggtagatattgtcgaggccgataaaacggatatttatttcattcaggagagtgtttatggcaaaatcgggttgccagcttttggtaatacaataggaccatccgcacagcaagttgttaaaaaggtattcgctgtcgttaaagaacgagataagacacatgcaaaacagagattattgttggaatataatggtaacaaactctggatgaatgctattgatggcagtgaagctatcctaccaacagaattttctaagcgatacgaactttcattattcaatactactaattttggagaagatccttttcctgatgttaatttatataataatatgaaatcaagtttttttgtaaggtttggtggaacatcccatcctgaggcttgggctatttataatgcaagtacgaaagaggttaaatatatagaaactgcaagagaaattgataaaatattcagtgattttaacttgagtggtccattgccaattcacattggtcaatgattttttaaattgtgtgattaaataattgaacattaatgatgatttatagcatcattattattctataacatgaataaacggattgaatgtgttatgttaaaaatgagtttatacgtaataatattgttattttcccttcagtttagtgcagccattactggcaaggaaagtgaggttgtttcaccattattaatggatgttaatccttcactaacaatggaaaatatttctgaattatccacatcatcggaaccatcgcaacagggggtatttcctgtaatatgtactcgacttcatcctggctccgtaatgaaacgtcagttattaaccggctgggggcctgtttttataattggtgatgatcctttttctctgcgctggatgagtgaacatctggagatccttaaatcgctaaatgcccttggtttggttgttaatgttgaatcagtagaacgaatggaggtattacagcagcgggctgatgggttattgttattgccagttatctgcgataattttgtgcaagctctgcaattaaatgcttatccggtattaatcacagagatggaaatatcacaatgattaataacataattactgctaataatatggtgattttgaaaatggtaatcctgttcacgacaccataatcagagttatgtcctgtatccgttcagtaaaatttcacgaatgctttattaaccggatgcgtgaatgtcattcttcagacgacatagacgtcattgcgattgatggaaaagcacttccacactcctgtgataaaagtcgtcgcaggagagcgggctttcgtagtcttccccgactctccccggccctaaacacaacccccactcaccacaacctaaactcatccgcatcctgccatgccggaaacttttctctatattcccgcaatgccatcatcgatagctccgcatcaatgcgcgttgcctgatgcgcgtcggcagtagcgataatctcgccttgtggattaatcacccggctgtcaccgcgataatggcagccgttgccatcgctgccgacgcgattacatcccgctacatacgcctgattctcaatcgcgcgggctgtcagcaatgcctgccagtgcagagaacgcggtgcaggccagttggcaacgtagatggcgaggtcataatcgttgagattgcgcgaccacaccggaaaacgtaagtcgtagcacaccagcggcaaaatacgccagccgcgccattccacaatcactcgctcattgcccgctttataatgcagatgctcatctgccatgcggaacagatgacgcttatcataaaaatgtaccgtgccgcccggctcaaccagcaaaaagcggttaaccgaatcagactccgtttgtaatgcaacactgcctgcaatcagcgcattgcactgctgcgctttagcggtcatccagctcactacgtcatcttgtgctagcgacgaagctgccgcttccatggcaaagccgctggtaaacatctccggtagaacgatcacatcgcgcccggtaataccttccagttgacgatcaaaatggcgcaggttggcaggaccatccatccacaccagtggttgctgcaaaagcgtaatcttcaaaccaggcacggtgtacaactcctttatgcgaagggttttataactctaacaccttatcaggcagttgccttagcgcagaataaattgataacaaatgctgatattggaaatatctgatttgcaaattatcgtgttatcgccaggctttagggagttaatcacatgggcaggataagcccgggaggaatgatgtttaaggcaataacgacagtcgccgctctggtcatcgccaccagtgcaatggcgcaggatgatttaaccattagcagtcttgcaaagggcgaaaccaccaaagcggcgtttaatcagatggtgcaagggcataagctgcctgcctgggtgatgaaaggcggtacttatactcccgcacaaaccgtgacattgggagatgagacgtatcaggtgatgagcgcgtgcaaaccgcatgactgtggctcgcaacgtatcgctgtgatgtggtccgagaaatctaatcagatgacggggctgttctcgactattgatgagaaaacgtcgcaagagaaactcacctggttgaatgtgaacgatgcgctttcgattgatggtaaaacggtgctgttcgcggcgttgaccggcagcctggaaaaccatccggatggctttaattttaaataattagcggataaagaaacggagcctttcggctccgttattcaattacgcggcttcaactttccgcactttctccggcaactttaccggcttcgtcgccagctcttccggatcaaagtcatcaacgttaatactgcgcagacggctttcttcagctttcaccagaatagcggcttcatctttatcaatcagccccttcgccagcgcgttgtgcgccagttcatccagacgggtaaacggcaggtttttacccagctctttacagatccgctgatgaatcgggtcggcggcaatcacatccactagcgcctcttccagtaaaccaaccgggttatgctcgctcggcgtcaggtactgaccgcgaccaatgcgggaacgggtggcgttcggcacttgtaaaatcttcgccaccttatgatccagcttgtcagaaggtgccagataatgacgtccggtcgggaagatcaccacattcagcagcccggcaaccacgcggttcgggaagttttgcagtaaatcgtccatcgcctgttctgcctgatacagcgcatcctgtacgccccagtgcaccagcggcagatcggcttcattacggccttcgtcgtcataacgcttcagaacggcagaggcgaggtaaagctggcttaaaatatcccccagacgtgccgagatacgctcgcgacgtttcaggctgccgcccagcacagccatcgagacatcagaaagcagggcgaggttggcgctcaggcggttcaggtgctgatagtagcgtttagtggcatcgccggttggcgtgctgctggttaaaccgcgcgtcaggcccagccagaagctgcgaactttgttgctaccgacgtgaccgatatgtttaaacaggagtttatcgaacgcgttgacgtcattgttcttcgccgcttccatctcttccagcacgtacggatggcaacgaatcgccccctgaccgaaaatcatcatgctacgggtcagaatatttgccccttcaacggtgatggcaatcggtgccccctggtaagcacgggccaggaagttgctttgcccgagcataatgcctttgccaccagtgatatccatcgcatcaataatcgactgctgcccgcggtgggtacagtgatacttaacgatagccgacagcacggcgggtttttcaccgagcataatgccgtaggtaatcagcgatgccgcagcatccattacataggcattaccggcaatacgcgccagcggctcttcaatcccttccatcttaccaatagaaattttgaactgacggcgaatgtgcgcatacgcacccgttgccagtgctaccgatttcacgccgccggttgagttggaaggcagggtgatgccgcggcctaccgagaggcactccaccagcatccgccagccttgcccggccattttcggcccgccgatgatgtaatcgatcggcacgaacacatctttaccgcgcgtcggtccgttctggaacggtacgttcagcgggaagtggcgacgaccaatttccacgcccggcgtggtggtcgggatcagcgcacaggtaatacctaaatcttctgcaccgccgagtaatttctccgggtcggagagtttaaacgccagaccaagcacggtcgcaatcggtgccagcgtaatgtagcgtttgttccaggtcagacgcattcccagcacctgctggccctgccattcgcccatgcagacaatcccggtatccggaatcgcgcccgcatcggaacccgcttcggggctggtcagtgcaaagcaagggatctcctgaccacgcgccagacgcggcagatagtgatttttctgctcgtcagtgccgtaatgttgcagcagctcgcccgggcctaatgagttcggcacgccgacggtaatcgccaggatcccgctcacgccggagagtttttgcagcacgcgagactgggcataagccgagaactccagcccgccgtactcttttttgatgatcatcgcgaagaaacgatgctctttaaggtacgcccataactccggcggcaggtccgccagctcatgagtaatctggaaatcattcgccatccggcaggcttcttctaccggaccgtcgagaaacgcttgctcttcagcggtcaggcgcggctgcggatagttatgcagctttttccagtccggcttgccctggaacaagtcgccctcccaccaggtggtgcccgcatcaatcgcttctttctcagtgcgcgacatcggcggcatcaccttacggaaaccgcgaaataccggtgcggaaatcatcgacttacgcataggcgcaaagttaaatggcacgaggataatggccagaggcactagtacccacgccgaccacagaccagcaacgccgaggacggctgtccaggcgagcaaaatcagactgctgataaataagctcacgcggtgatagaacaatgcgccgagcaggacaaccgtagcgagaatactcaaaatcatcataacgaaaagccccttacttgtaggaggtctgaccacttgtgatgatatggttgtagtggatgtaaaaacatttagcaatgtgtttacaatataattacaacaaagctcacattgttgctgtttttatccgcacttcaggtcaaaaagtcctggtcatagcacctgcccgtacttctcgcttttggcggtatccggtacactgcattttgtctattacatttatgctgaaggatatcctcatgtaccaggatcttattcgtaatgaactgaacgaagcggcggaaacgctggctaactttttaaaagatgacgccaatattcacgccattcagcgcgcggcggtcctgttagcagacagctttaaagccggtggcaaagtgctttcctgtggcaacggcggctcccattgcgacgccatgcactttgccgaagagttgaccggtcgctaccgtgaaaaccgtccgggctacccggcgattgccatttctgacgttagtcatatttcctgcgtcggtaacgattttggtttcaatgatattttctcccgttacgttgaagcggtaggtcgcgaaggcgatgtactgctggggatctccacctccggtaactctgcaaacgtgatcaaagcgatcgcagcggcgcgtgagaaggggatgaaagtgatcaccctgacgggtaaagacggcggcaaaatggctggcacggcggatattgaaattcgcgttccgcactttggttatgccgaccgcattcaggagatccacattaaagtgatccatatcctgatccagttaattgaaaaagagatggttaagtaagtctggcgtaggccggataaggcgtttacgccgcatccggcatttgtgctctgatgcctgatgcgacgctgacgcgtcttatcatgcctacaatctgcacccgaaccgtaggccgaataatgcgttcacgccacatccgacctgaaaattcttaaatcaatcttcgccgggggccatgcgctcccgctgttgtggaggttacccatgtgcgaattgctcgggatgagtgccaacgtccctaccgatatctgctttagtttcaccggacttgtacagcgtggtggtggaaccgggccacataaagatggctggggcattaccttttacgaaggtaaaggctgtcgcacatttaaagatccgcaacccagctttaattcccccatcgccaaacttgtccaggactacccgataaaatcctgttcggtggtggctcatattcgccaggctaatcggggcgaggtggcgctggaaaatactcacccgtttacccgcgagttatgggggcgtaactggacttatgcccataatggacaactgacgggctacaaatcactggaaaccggcaacttccgcccggtcggtgaaaccgatagcgaaaaagccttttgctggctcctgcataaattaacgcagcgttacccgcgcacaccgggcaacatggcggcagtgtttaaatatatcgcctcactggcggatgaactgcggcagaagggcgttttcaacatgctactttcggatgggcgctatgtaatggcgtattgctcgactaatttacactggatcacccgccgcgcgccgtttggcgtggcaacgttgctggatcaggatgtggaaatcgacttcagctcgcagaccacaccgaatgatgtggtcacggtgattgcgacacagccgctgacgggcaatgaaacctggcaaaagattatgccaggtgaatggcgcttattttgcctcggggagcgtgtagtttgatgccagttgtggctgcacaacttcgtggcttaacggcttgctgaccacgtaacggccattgaccacagaaacggtcggtggcttacgggtttgctcaaagtagtcgtagcccggcttcagttgctcccagaagtccttaaagttggaatatttatggcgcttcatattggcgtcggtcatgcggaacggataaatactcacttgcacgctcggctgaccaaacaccagcgcaccagtaacgaactggaagatctcatcaataccctgattggtcatcgcgtagcagccgatggaaacacaatcgccgtgaatcatcaggtatttcccttcataaccatgcgcacggtcataggcatttgggaatccaatattaatcgctttgtagtaacggctgtctggttttaactgattacgctggacgctataaaacccttccgggcttttgaaatcgccctgacgctgttttggccctaagccgccggaatatttacagattttatagctgtcgagcagttgatattgctcgcccattttgacgtagagatcgagcgtacgttcttccttgaagatctggatgtagacaggggatcccatcaactgctgcttatactctttgctcactggcgtggtcgagctactgctgcccagcaaaccggcaaacgaaacgcacgggatcaacaacatcgcaagaattaatgcgattttacgcatactgcttattccttgataaaacggttacacacgccaggacggcaaaatgaatcccaaatcggaatagtctggatttggaaggctcacattatcaccaaaagagttttacgcaagcctgtcggcgcagggtttacaaatttagcacaggggcagttttcaagagtccgaaaagcgcatggattgtagatttatttcttatttcctaagattatgaaaccgcaatagtaatatgcaaataagcaattaataatcccgtttactcctccggtcttttaaaattctcaccttcattcagctggtttatgtccttcatgtcttcgttcttgcacggcagatttctgcatccaggcgtgttttcgttatgcgttttgctccctttactcgccagcgccaccacatcacatatctcttttagctacgccgcccgccagcggatgcaaaaccgtgcgcgtttattaaaacagtaccaaacccatctgaaaaagcaggccagctatattgtggaaggcaatgccaaaagcagaagggcgctgcgccagcataatcgggagcagataaaacagcatccagaatggtttcctgcgccgctcaaggcgagtgacagacgctggcaggcgttggtggagaataatcatttcttaagcagcgaccatctacataacatcaccgaagtggcgattcaccgcctggagcagcagctaggtaagccttatatctgggggggcacgcggcctgataaaggcttcgactgtagcgggttggttttttatgcctacaacaagatccttgaggctaagctcccgcgcacggccaatgagatgtaccactaccgtcgggcaacgattgtggcgaataacgacctgcgccggggagatttgctgtttttccatatccacagtcgtgagatagccgaccatatgggcgtatatcttggagacggtcagtttatcgagtcaccgcgcaccggggaaaccattcgggtaagtcggttagccgaacctttctggcaggaccattttttaggcgcgcgacggattttgacggaagagacgattttgtaggccggataaggcgttcacgccgcatccggcggttgtgcgccggtgtctgatgcgacgctacgcgtcttatcatgcctacaaatctgtgcattttttgcgagccgctttcccgatttaacacaacatcattgccgacttttccttttcttcttaccgttgagaaaaaggagtcgttatgtctgaatatcgtcgttattacatcaaggggggaacctggtttttcacggtaaatttacagaatcgtcgaaaccaacttttgaccacccagtttcagacgctccgtaacgctattattaaagttaagcgagacagaccttgtgaaattaacgcttaggtagttttgccggagcatatgcattgcatatggacattacctgaaggcgatgatgatttttcctcgcgctggcgggaaattaaaaagcaatttacccatgcttgtggattgaaaaatatctggcaaccacgtttttgggaacatgctatccgcaataccaaagactatcgccatcatgttgattatatttatataaatccagtaaaacatggttgggtaaaacaagtgagtgattggccattctcaacgtttcaccgcgatgttgcgaaagggttatatcccatcgattgggcgggagacgtaacggattttagtgctggggagcgtatcattttatagctgtgcgccgatgcctgatgcgacgcagacgcgtcttatcatgcctacaaaaccgcgctcacccgtaggccggataaggcgttcacgccgcatccggcggttgtgcatcggtgccagatgcgccgctacgcgtcttatcatgccgacaaaaccgtgctcacccgtaggccggataaggcgttcacgccgcatccggcggttgtgcgccgatgcctgatgcgacgcagatgcgtcttatcatgccgacaaaaccgcgctcacccgtaggccggataaggcgttcacgccgcatccggcggttgtgcaccggtgccagatgcgccgctacgcgtcttatcatgccgacaaaaccgtgctcacccgtaggccggataaggcgttcacgccgcattcggcaatatgcaccgatgccggatgcctacatcaacgcccccattatcttcaactccagctcatccggcacttcgttatacgacagcacatgcagccctggtgcaaacaaccttgcgtagcgcgccagcaaagggcgcagctgcggcggcaccagcagcaccggatctttccccgccgctttcatctgctccttcacctgcggcatcgtgatctgaaactggttgagcatattcgggtccaccggcacgctatcgagcatcactttgccggcctgttgcgcctgattcaccatgttggtcagcagattttccagctcattattcagcgtatacaccgtcagctcctgcttgcgaacgaacggatgggtaatgctgcgccgcagcgccaggcgcacatcggccgccagcagaatatgatctttagtcaccgcactactggcgaccaacacggtggcgatggtgacgatatcgcgcagggaaacgccttcagtcagtagcgcccggtacactttcagcaactggctgtaattgagcgccgcgctcaaatcttccgccagtcgcggtgccatcgacgacaaacggttatgcagctgagtaatatcgtcatagttaaataaataaggaatatagctgcgcacaatcttattcacatgggtggcaattacgctggcgctgtcgatcacctgataccccatattcagcgccttcgctttctgcgcgggctgaatccaggtgaccggcatcccgtacgccgggtcgttccccagcacgccgtctatctcgccgtaggtttcgctggagggcagggccatcagtttatccgccggaatatccgcttcatcagccttaatgccgttgatgaaaatagcgtactggctgggcttgaggcggaagttttcccgaatacggatctccggcagcagcacgccgttgccgtcggaaatcacctgacgtacgccgcgaatacgctgggtgagcgggttgccctgcgctttatccaccagcgccaccagtttgtagccgaggcttaaactgataggttcgatcagcggaatagtttcccaactgacctgttgctcgctggtttctgtcatcgtacgggttagcgtttcgaggcttttctcttccgcctccgccgcttgcgggcgcttgctcatccgccagccggtaaaaccaagcagggcgctgaacatcaggaacgggaaatgcggcattcccggcaccaccgccagcacgaacataattccagtggcggtgtagagaaccgacgggcttgccagcaactgattacgcacgtcatgggcgatatcaccgttatcgctgacgcgggtgacgataatcgccgccgcggtggagagcagcagggaagggatttgcgccaccagcccatcgccgatagtcatcagcacatattgctggaaggcggcgtcggcgctcaggttgtatttgaagatgccgatacagacgccgccgatcaggttgattgccagaatcatcatcccggcgatggcgtccccgcgcacaaattttgatgccccgtccattgcgccgtagaaatcggcctcgctggcgacatctttacgccgggtctgcgcctgcgcctgattgatcaacccggcgttaaggtcggcgtcaatcgccatctgtttgccgggcatcgcgtccagggtaaagcgggcagaaacctcggaaatacgctcggcccccttggttacgacgataaagttgattgtcaacagcgtcagtaaatccgagcgtgaaagcattatcgccgcgctgcacgggcagtcgatttttaacggtggtgggttgtcgccgttaaataaaatcagcccgtctcatctgccaaaacctgccaccgtggcggtgccggaagagacggagaaaaaagcgcgcgacgtcaacgagaaaacggcgctgttgaagaagaaatccgccaccgagcttggcgagctggcgaccagtatcaataccatcgcccgtgatgcgcatatggaagcgaatctggagatggagattgttccccagggattacgcgtgctgattaaagacgaccagaaccgcaatatgtttgaacgcggcagcgcgaagattatgccgttctttaaaacgctgctggtggagcttgcgccggtgttcgactcgctcgataacaaaattattattaccgggcatactgatgcgatggcctataaaaacaatatctacaacaactggaacctttcgggcgatcgcgcgctttcggctcgtcgggtgctggaagaggctggaatgccggaagataaagtgatgcaggtaagcgcaatggcggaccagatgctgctggatgccaaaaatccgcaaagcgcgggcaaccggcgcattgagattatggtgctgaccaaaagtgcgtccgatacgctgtatcaatactttggtcagcatggggataaagtggtgcagccgctggtgcaaaagctggataagcagcaggtgctttcgcagcgagcgcgttaaatgctgaatctttacgcatttctcaaaccctgaaatcactgtatactttaccagtgttgagaggtgagcaatgcgtaaaatcattcatgtggatatggactgctttttcgcagcggtggagatgcgcgacaatcccgccctgcgagatatccctattgctattggcggcagccgcgaacgacggggggtgatcagcaccgccaattatcccgcgcgtaaatttggcgtacgtagcgctatgccgacagggatggcgctcaaattatgcccgcatctcaccttgcttccagggcgctttgacgcctacaaagaagcctcaaatcatatccgcgaaattttctcgcgctatacctcgcgcattgaaccgttatcactggatgaagcctatctcgatgtcaccgatagcgtccattgccacggttctgcgaccctcatcgcccaggaaatccgccagacgatcttcaacgagctgcaactgacggcgtctgcgggcgttgcgccggtcaagtttctcgccaaaatcgcctccgacatgaataaacccaacggtcagtttgtgattactccggctgaggttccggcatttctgcaaaccttaccgctggcaaaaattcccggcgtcggcaaagtctcagcggctaaactggaagcgatggggctacgaacctgcggtgatgtgcaaaagtgtgatctggtgactctgctcaaacgttttggcaaatttggccgcattttgtgggagcgtagtcagggcattgacgagcgcgatgttaacagcgaaaggttgcgaaaatccgtcggtgtagaacgtacgatggcggaagatattcatcactggtctgaatgtgaagcgatcatcgagcggctttaccctgaactggagcgtcgtttggcaaaggtaaaacctgatttgctgattgcccgccagggggtgaaattaaaattcgacgattttcagcaaactactcaggagcacgtctggccgcggctgaataaagctgacttaatcgccaccgcgcgtaaaacctggaatgaacgccgtggcgggcgcggtgtgcgtctggtggggctgcatgtgacgttacttgaccctcaaatggaaagacaactggtgctgggattatgatgtatactattatgtatattctgatgtgcattattatgaggggatcactgtatgcatcgaattctcgctgaaaaatcggtcaatatcactgagttacgtaaaaacccagctaaatactttattgatcaaccggttgcggttctttctaataatcgccccgcaggatatctcttaagtgccagcgcatttgaagcgttaatggacatgcttgctgaacaagaggagaaaaaactggttaaggcgcgcttccgtccgagtgccgcaagattagaggaaattacacgccgcgctgaacaatatcttaatgatatgacggatgatgatttcaatgactttaaggaataaggatgcgggtattcaaaacaaaacttattcgcctgcaacttacagcagaggaacttgaagcgttaacggcggattttatttcctataagcgtgacggtgttttgccagatatatttggtcgcgatgcactctacgacgactcgtttacctggccattaatcaaatttgagcgagttgctcatattcatctggcaaatgtgaataatccatttccgccacagttgcgccaattcagcagaacgaatgacgaagcgcatttggtatattgtcagggtgcgtttgatgagcaagcatggttgctcattgccattctgaaacctgaacctcataaactggctcgagataacaaccaaatgcataaaattgggaaaatggcagaagcgtttcgcatgcgtttttgaatttatattatgaataacatacaaataagaaactatcagcctggtgattttcagcaactatgcgctattttccttcgagctgttacgatgacggcgagtcagcactattctccacagcaaattgccgcctgggcgcagattgacgaatctcgctggaaggagaaactcgcgaaatcacaagtgcgggttgcagttattaatgcacaaccggttggttttattacctgcattggacattatatcgatatgttatttgttgaaccggaatacacccgacgcggggttgccagcgctttgttaaaaccattgattaagtctgaatccgaacttacggtggacgccagcataaccgcaaaacccttttttgaacgttatggttttcagacagttaagcagcagcgcgttgaatgccggggaacgtggtttactaatttttatatgcgatataaaccgcaacattaaatccagcttgcaatgaaaataacgcccgtctagtatgtgcgcgttttcttattccacaaactgcaaggaggtaaatcatgacaaatcctttatcaatgactctttgcagacctttccaggattaattcttttttcttgccctggattcgtctgccatttcctgatttttattcataaatggaatggtacatgggcaaatatattcgtcccttatccgatgcggtatttaccatcgcatctgatgacctgtggatcgaaagttcagcgatccaacaattacacaccacggcaaatttacccaacatgcagcgcgttgtggggatgccagatttacatcccggacgcggctacccgattggcgcagcgttcttctctgttggtcgtttttacccggcactggtcggcaatgatatcggctgcggcatggctctatggcaaacagatattctcgctcgcaaatacaacgccgataagtttgaaaagcgattatcagatctggatgacgttgctgaagaaagctggctggaggaaaacctgccgtcagcatttgcacagcatccgtggcgcaactcgcttggctccatcggtggcggtaaccacttcgcagaactgcaacagattgatcaaattatcgacgcggaactgtttgcactggctggtctggatgcgcagcatctgcaactgctggttcatagcggctcgaggggattggggcagcctattttacagcggcatattgcctcgttttcgcatcatggtttgcctgaaggcagtgacgacgcgctacggtatattgcggaacatgatgatgcgctggcgtttgcgcgtattaatcgccagctgatcgctttgcgcataatgcaacaagttaaggccaccggaagtccggttctggatgtggcgcataactttgttagcgcgtgccaaatcggcgatcaacagggctggttgcatcgtaaaggcgccacgccggatgacaacggtctggtgattattcccggttcacgcggcgattactcctggctggttaaacctgttgcgaacgaaaaaacgctccactcgctggcgcatggggcggggcgtaaatgggggcgcaccgagtgtaaagggcgtctggcagcgaaatacacggcgacgcaactctcgcggactgaacttggcagtcgggtaatttgtcgcgataaacaactcatctttgaagaagcgccacaagcctataaatcggctgaaagcgtggtgcaatgtctggtgctggctgggttaattattcctgtcgcgcgactgcgcccggtgctgacgctcaaaaacagtggagggaaaaaaggatgatcttgctacaactctcctctgctcaggggccggaagaatgttgtctcgcagtgaaaaaagcactggacaggctgattaaagaagctacccgacaggacgtcgcggtaacggtgctggaaacagaaacgggtcgctactctgacacactgcgttcggcgctgatttctctggatggcgataacgcatgggctctaagcgaaagctggtgcggcactattcagtggatttgtccgagtccgtatcggcctcatcatgggcgcaaaaactggtttctgggcattgggcgttttaccgctgatgagcaggaacaatcggatgcaatccgttatgagacgctgcgttcgtcggggccgggcggtcaacatgtcaataaaaccgactcggcggtacgcgccacgcatctggcatccggtattagcgtgaaggttcagtcagagcgcagtcagcatgctaacaaacggctggcgcgattactgattgcctggaagctggaacaacagcaacaggaaaatagcgcggcgctgaaatcgcagcggcgaatgttccatcaccagattgaacgtggcaacccgcgacgaacgtttacagggatggcctttatcgaagggtaatgaaggatgaaactgccggaaggcgattaaacgccatccggcagcaaatcaaataattacttcgccggaatttctttcagcagttcagtcagaagcgtccagtaatgaccaacgctttcgatatgaacttgctcatccggggagtgtggaccggtgatggttggcccgatagacaccatgtccatttccggatacggttttttgaacagaccacattcgaggcccgcgtggataatctggatgttcggcgttttgttgaacagacgctgataggtttcacgtaccagatgcattaccggagagttagcgtccggctgccagccaggatatgcgccttttgcttctgttttcgcacctgccagtttacccagtgaatccagcatgctcactacgtagtctttaccgctgtcgatcagagaacggatcaggcagtgaatttctacgttattgtcggtcatggtcaccacaccgacgttcagggaggtttcgaccacaccttttgccacgtcggagttgcggatcacaccgttcggggtggcgttcagcagacgaataaaggtatcgcgagatttcgcaatcagggcagctttatcgttcgcaacagagtccagcagcaatgccagatttttctctttctctgccagttcgtttttcaggatctcctgataggtatccaccagagatttcagggcgtcgactttatcagctgcgacagcaatggtcgcaaaggcttcacgcgggatggcgttacgcagtgtgccgccgttgaaatcaataagacgcaggtccagttcttctgcatgacccgccaggaagcgcaccaacagtttgttggcattacccaggccaacgtggatttcaccgccggagtgaccgcctttcagaccttttaaggttaacttgaaggtttcaaaaccagctggaaccgcttcacgatctaaatgcaggttggaggtgaagtcgatacctcccgcacaacccatgtagatttcaccttcttcttcggagtcggtgttaatcagaatatcagcctgcaaccagttgctctgtaagccaaaagcaccgtccataccggcttcttcggtcatggtcagcagcacttccagcgggccgtgaaccacgttttcgtcagccagaaccgccagtgcagaggccataccaatgccgttatccgcacccagcgtggtgccgcgtgctttaacccattcgccatcaatataaggctggataggatctttggtgaagtcatgcacggtgtcgttatttttttgcggcaccatatcgaggtgggcctgcaagacgaccggtttacgattttccatacctgcggtagcaggtttacgaatcaggatattacctacctgatcgcgttcgacatggaaacctttctcttttgcccaaccaacaatgtattcagcgagttgctcttcatgataggacgggtgaggaatagaacagattttggcaaaaatatcccacagcggctgtggagataattgagacagttcagacacgttaagtctccttgtcgatcacccgcaaaacagtattgcaggtcacagggttagcagaaaatgttgtcaacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtagataccggtggtactgcggttgcgattcgtgaaatgtatccaaaagcgcactttgtcaccatcttcgcaaaaccggccggtcgtccgctggttgatgattatgttgttgatatcccgcaaaatacctggatcgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttagtcacggcgcacaactgcctgtgcagtcggcccttgatggtaaaaccatccctcactggtatcgcatgattaaccgtctgatgtggatctggcgcggcattgacccacgtgaaatcctcgatgtccaggcgcgtattgtgatgagcgatgccgaacgtaccgacgatgatttatacgatacggtgattggctaccgcggcggcaactggatttatgagtgggctacccaggcgatggtgtggcaacaaaaagcctgtgcggaagaagatccgcaactcagcggtcgacactggctgcatgcggctacgttgtacaacattgctgcctatcctcatctgaaaggagatgacctggccgagcaagcgcaggctttgtcaaaccgcgcctatgaagaggccgctcagcgtctgccgggcacgatgcggcagatggagtttaccgtacccggcggtgcgcccatcaccggctttttgcatatgccgaaaggcgatggcccgttcccgacagtattaatgtgtggtggtctggatgcgatgcagacggactattacagcctgtatgaacgttattttgcgccgcgcggcattgctatgctgactattgatatgccgtcggtgggcttttcttcaaaatggaagctcacccaggactccagcctgttgcatcagcacgttttaaaggcgctgcctaacgtaccgtgggtggatcacactcgcgtcgcggcctttggtttccgtttcggcgctaacgttgccgtgcgtctggcataccttgaatcgccgcgtctgaaagtggttgcctgtcttggtccggtagttcataccctgttgagtgattttaagtgccagcaacaggtgccggaaatgtatcttgacgttctggccagtcgtttagggatgcatgatgcttccgatgaagcgttgcgagtggagttgaatcgctattcattaaaagtgcaaggattgctgggacgtcgctgcccaacgccaatgttatcaggctactggaagaacgatccgttcagcccggaagaggactcacgcttaatcacgtcgtcatctgctgacggtaaattattagagatcccatttaacccggtgtatcggaattttgacaaaggccttcaggaaatcacagactggatcgaaaaacgtttgtgttaaaaatttgctaaattttaccaatttggtaaaacagttgcatcacaacaggagattgcaatgacgttaccgagtggacacccgaagagcagattagtcaaaaaatttaccgcactaggcccgtatattcgtgaaggtaagtgcgaagataatcgattctttttcgattgtctggctgtatgcgtcaacgtgaaaccggcaccggaagtgcgtgagttctggggctggtggatggaactggaagcgcaggaatcccgttttacctacagttaccagtttggtctgttcgataaagcaggcgactggacgagtgttcagataaaagatgccgaagtggttgaacgactggagcacaccctgcgtgaatttcacgagaagctgcgtgagctgctggcgacgctgaatctgaagctggaaccggcagatgattttcgtgatgaaccggtgaagttaacggcgtgaatgaaatgtgccggatgcatcacatccggcaatatccattaaaactgataggtcatgccaaccgcgacaatatcatcattattaatattcaatttgttatcgctatccagttggttgattttataatcaacaaacgctgacatatttttgttgaaataatacgtagcaccaacatcgacataattgaccagatcttcatcaccgatgccctcaatatctttccctttcgataagacataacccagcgatggacgcagaccaaagtcaaactggtattgagcgaccgcttcaaagttctgcgtcttattggcaaagccgccagagattggcgtcattttacgtgtttcagaatagaaagttgccagataaatattattggcatcgtatttcagacctgttgcccatgcttctgcacgcttgcctgtgccacggctttgcaggttctgctcgttggtgcgatcagagttggtataggctccactgatggcgaaatcgctgccaccaaagtcatatgtcaatgacgtgccgaagccatcgccgttttgctttttaacgtcgcggttttcgtttttcccttgatattgcagggttaagttcagaccatcgataacgccgaagaagtcggtgttccgatacgtcgccagaccgctggcgcgtttggtcataaagttgtcggtctgcgccgaggagtcgccaccaaattccgggaacatatcggtccaggcttccacgtcatacaacgcgcccaggttacgaccataatcgaaagaacccaaatctttatatttcaacccggcaaaagcgagacgcgttttttgctgtgcagtatcactctccgctttattaccggcaaactcagcttcccaacgaccataaccagtcagttgatcgttaatttgtgtttcgcctttaaaaccaaaacggatataactctggtcgccatctttactgtcattatcactcatataatgcatggctttaactttgccatagacatccagtttattaccgtctttgttatatatttctgcggcctgtacggatacagatgccacaatgcccatcaccactaatgccagagtgctctttttcattttcattcctgattttaattaacgcgcgaatattcagcgggagagtcccgttgaaaacaggaaagtttttaacctgagattgttaaagatatattacagattaataatattcttaaaatgtggtaatttattaaatctgtaataaaagcgtaaacaactgccgctacgcttgctgatcccgcgcaacaaaacgccatgctttgctcgcagatggttggcaaccgacgacagtcctgctaaaacgttcgtttgatatcattttttcctaaaattgaatggcagagaatcatgagtgacagccagacgctggtggtaaaactcggcaccagtgtgctaacaggcggatcgcgccgcctgaaccgtgcccatatcgttgaacttgttcgccagtgcgcgcagttacatgccgccgggcatcggattgttattgtgacgtcgggtgcgattgccgccggacgtgagcacctggggtacccggaattgccagcgactatcgcttcaaaacagctgctggcggcggtagggcagagtcgactgattcaactgtgggaacagctgttttcaatttacggcattcatgtcgggcagatgttgctgacccgtgctgatatggaagatcgtgaacgcttcctgaacgcccgtgataccctgcgtgcgttgctcgataacaatatcgttccggtaattaatgagaacgatgctgtcgctacggcagagattaaggtcggtgataacgataacctttctgcgctggcggcgattctggcgggtgccgataaactgttgctgctgaccgatcaaaaaggtttgtataccgctgacccgcgcagcaatccgcaggcagaactgattaaagatgtgtacggcattgatgacgcactgcgcgcgattgccggtgatagcgtttcaggcctcggaactggcggtatgagcaccaaattgcaggccgctgacgtggcttgccgtgcgggtatcgacaccattattgccgcgggcagcaagccgggcgttattggtgatgtgatggaaggcatttccgtcggtacgctgttccatgcccaggcgactccgcttgaaaaccgtaaacgctggattttcggtgcgccgcctgcgggtgaaatcacggtagatgaaggggcaactgccgccattctggaacgcggcagctccctgttgccgaaaggcattaaaagcgtgactggcaatttctcgcgtggtgaagtcatccgtatttgcaacctcgaaggtcgcgatatcgcccacggcgtcagtcgttacaacagcgatgcattacgccgtattgccggacaccactcgcaagaaattgatgcaatactgggatatgaatacggcccggttgccgttcaccgtgatgacatgattacccgttaaggagctggccgatgctggaacaaatgggcattgccgcgaagcaagcctcgtataaattagcgcaactctccagccgcgaaaaaaatcgtgtgctggaaaaaatcgccgatgaactggaagcacaaagcgaaagtatcctcaacgctaacgcgcaggatgttgcagacgcgcgtgccaatggccttagcgaagcgatgcttgaccgtctggcactgacgcccgcacggctgaaagacattgccgacgatgtgcgccaggtgtgcaatctcgccgatccggtagggcaggtaatcgatggcggcgtactggacagcggcctgcgtcttgagcgtcgtcgcgtaccgctgggggtgattggcgtgatttatgaagcgcgcccgaacgtgacggttgatgttgcttccctgtgcctgaaaaccggtaacgcggtgatcctgcgcggcggcaaagaaacctgtcgcactaacgctgcaacggtagcggtgattcaggacgccctgaaatcctgcggcttaccggcgggtgccgtgcaggcaattgataatcctgaccgtgcgctggtcagtgaaatgctgcgtatggataaatacatcgacatgctgatcccgcgcggtggggctggtttgcataaactgtgccgcgagcagtcgacaatcccggtgatcacaggcggtataggcgtatgccatatttacgttgatgaaagcgcagagatcgctgaagccctgaaagtaattgtcaacgcgaaaactcagcgtccgagcacgtgtaatacggtagaaacgttgctggtgaataaaaacatcgctgatagcttcctgcccgcattaagcaaacaaatggcggaaagcggcgtgacgttacacgctgatgcagccgcgctggcgcagttgcaggcaggccccgcgaaggtggtggctgttaaagccgaagagtatgacgatgagtttctgtcattagatttgaacgtcaaaatcgttagcgatctggatgacgccattgcccatattcgtgaacacggcacgcaacactccgatgcgatcctgacccgcgatatgcgcaacgcccagcgttttgttaacgaagtggattcctccgctgtttacgttaacgcctctacgcgttttaccgacggcggccagtttggactgggggcggaagtggcggtaagcacacaaaaactccacgcgcgtggcccaatggggctggaagcgctgaccacttacaagtggatcggcattggtgattacaccattcgtgcgtaaataaaaccgggtgatgcaaaagtagccatttgattcacaaggccattgacgcatcgcccggttagttttaaccttgtccaccgtgattcacgttcgtgaacatgtcctttcagggccgatatagctcagttggtagagcagcgcattcgtaatgcgaaggtcgtaggttcgactcctattatcggcaccatttaaatcaataagttagataagtgtgtgcctagattttcttgcagtttgtcatttgggtacacacaggggacacaaagcacaaaagtgtgtacatttggttttggtgtcctcgtgtttacttcttaccgttgatataaattcactttcttgttgacaaaaattgtaagcatgtcgaatggcaatgtagacatcgctattagttgtttggcaaggtatttattgagtgtaaacataaaaactttatcaatatatgctcagactgatgaggtcagtattgatactgatgttttcaaattttaggtcataaaatggctgtcattccaatgtcttactcccctgctactgtagctcgtcgtttttcgatactggatggagtaactattcagggtgtgctttaccagatcatctgggatccaaagactccgttcgctgcggtaatcgaagctgcaccttctgttattgatggtgatattcgccataaggttgttgccactctggagcttcagcgtcgttcacagcttgaaggggtgtttgtccggaaattatgggaagaacaggacgttgctcagattgaagggattgttgtcgatggcgctgtacgtgatgttagccttgctacgtttgtttatgaaacaatagccacaaaagcaggcgttatactattaagtgataacgagcaatatgaaggaggtaaagccctctggcagcatatagcgcgtcgttcaacgaatcttaaggtgtttatcttagatacagattccgcacggtattatccgtttgatggtgatcggatctgctatgatggggaaagtattctgaatcagaaatctggagtgaacatcctgatcgaaacaaacacggtgttgttcttgtggccgaatctgttaatggaaaagccgcataatttgccgattgcctcgtgttcctggagctctggcaacctgaagcagaacaaacaggggataaccgggatgttatcccatctgtgatctactgcccggtcaggcattttccccataaaggtcgaatcacatctctatcttcactgtagggaaatcttttattttttttcttctgttccaacaggaatgcgtcaatttcgttattgataatctccttaacagtgcggcgataacggtttagcgacgtatcacttatatttttctttgacaggcgtaaactggtatcggctttgatgtcttcatttatgccatctttaacttttcgttttggactatccggaatcccttcatgcagatcataggctttcagccctacaagtcgtacggcaacgtcaatcttctctgttcgtttttgtttatgactttctaacaaaactttattttttttataccatttttgaaatgtttccagacgcttctcattatctttactgagctccaggagagaatgaaatttaatattatttgttatattaattttactctctgatgtcggaggttttattcctgggaactctatctcattttgggatgatttcttgtattccttctgcagacaatgacaaagataaattactgcatcctgaagggtattggtgtgaatcaacctcagaagttcatcacgttgtatggttatctggcaataatccttttcccatgcagttgtatgcccggtttctgtatctttatccggagtaactgttgcgaatttccatgtatatcggataaaatctgttggtttaaaatacttcatggttttgttgaaccagtcaatgatttcattggcataaagacggacgtattcatagtatattgactcaatttcataccagttggcgacccgacacaaattattcacgaattctgtacgtcctgttttcaacagttgttctttccgtctgattacatccccggtattttgctccggacaatctctgaatattttatgttcctctttaaagggggatagccattctggaaggtctgtattatttttcttgtagaatccgttaactgttataccaataactctggcaagtattgctgattcatcaatttcatgatattgattcaggtgtgccagtaactctgaggtgcaggagtgtgcaacagacagatcctgatggcaatacccctgtcgggtttctgctggaattggtgaactccaggccttacattcagtcagaatattaaataaatcatctcctacaaactttgccagttcaggtgttttccaggttctcggtcctgggctgataaaggttgatgttgtctgtacctcttgcatcgccccccaggttttcagactgatatttccttcatcaaaaccattgtataaatggcacatcacattaagcgcatctgtaagagcagaaggagtgggttggggggaggtagactcttcaatagtaagctttggttcttcagcgcttctttgttctctaaagattctcaggagctctgtattggcacgtaatgcagagagtactctgtgctgttcttcaaaccaggggcgatattctggatcctgatatagttgacgtgctttaaaaatgagcaaaaggatttgttcggaaaccgcctcgtatatgccagggaatgggtggagttcgccggataaaacacgatcatactgatacttttgttgcattgtccgagttaccatgatgtcagaagtttctgcttgctacatattggtccgctgtcagacagaatcgatgttgtccactgaaatgaaacgttaatcctgagccagccgctgattacgtggatagcttgtgtacatttgtttatatcctgagattttatacattatttacgataattttctcctgattgtgattgtctccgtcagttacctctgcgtcttctgtataagcgtatttgcttcattttccgatcattcgtagcctgcttctgtctgttcagcaacagattgtcttttcctccgcttgttgtagcttatttttgtgatgattatcacaaattagatggaaatatttcaccttcctgcgactcctccatgccttgtttgaattttacatggatttatttatatatcccaacctaattttagtcaacaaaaatcgtcataatggatttttaatattaattctttgtttttattggtcgcggcttgtttttatttggttctatatgtctttattttttctattaaaagccattttaacattgcaattcagtattttgacctataaaaatcatagtattacattttatttgtaggtgttgactggatgaatgatagtgactttcactcattgtttatccgggaaacttagtcatttcatgctcatgccggaaataaaaagtattgatatatcaggagggtagtatgtggcttccattaacagatgaacagcgtctggtcattttgaaagcttatgggattgaatgcgacagactggtacgtgaaaaggaacgatatgagatcacgtcaatttctcgtacacaagcgtggaaacttgaacgggagggaacatttccaccacgtaagtctatcggaaagaaatcttgcggatggttgttaagtgaccttctctgctggatacagaccagatgaactgtctgtattttcagtatatccagtctgtatagcagctattgttgctattgtagcggaaatagctgctataaccgaaagttattacgaaaaaaggaaatatttatgtcttacatcaaaccggatactccgtatccagtatatgcgcaaccatcaatgactggaaatgcaataattgaaactcaacacaatgaaaaagcatctctggctatgactacaacatcattattaacagcgatgtcaattgcctgtcagaatcagattgacgtgtgcaaccccggaaatttacgtgggcccgttaatatttacactatggttctggctgattcctgagaaaggaaaaagaccggggggaaggtgttagtgaaataattttaggaggtgttaagaatgagaaacatgaatgatatttcgtggtaaataacacagtatgaactgaattaaccttatcggtttattaaacatcagatctacagatattctgtatttctcagaacattaggtctgaacagcagctatttctctattatagagggagttgctgctactttactaacccattaatgaaaagagaggcttttatgtgcttacttgcaccagaaaatccttatccgatatatgcactaccaccgctggtgagaaatgcaataattgaaactcaaaaaaatacacaggcacctttggctatggtggcgacatccgcattaacagcgatctcaattgcctgtcagaatcagattgacgtgtgcagacctggaaatttacgtgggcctgttaatctttactctctgattctggctgattctggtgaaaggaaaacgaccgtggataaagtgtttatgaaagcattttatctcagggatgaagccctggcggaagaatacgcgaaactggttgagaattacagcacagaaaaggaaatatgggagcaaaaacaaaaagcgctggaatcaaaatttcataaagagattcgtgccggtaaagattacaaggcaacagaatcagagcttgaaacgcatctgaataagtctcctgttccgccgcagatacgtcgaacaatttttaatgagacaacgatagagggaatgttaaaatattactccgatagcaatcgttcttttgctcttgtatccagtgaaggaggggtaatttttgacagccgggccatgagtaaactgggaattattaacactttgtgggatggaggttctcttttcatcgacaggaaatcatctcccggaattaatttgaaggagccaagactgacgatgtcggcgatgattcagcctgatgtttaccacaaaggtttttgtacgcgaaaaaagaacttgtgaaaacgtcaggacatcatgcaaggtttttgatgtgtcaaccaacatcaacgcaggggacaaggataataaccggagataattattcatcacagtatcaggatttgtttgaacagaggatcaatgagcttattgatgaaagtctggcgatgagtggtgaacgacgttgccttcacttttctcctcaggctgccagaatctggacggattattacaatgatgtggaatcgaagctggggggattggggcctttaagacattgccgggaatatgctgctaaaaatgcagagtatatggcaagactggcaggacttatttaccattcgagcggtgaggagggggagatttccccttacattgcagaaatggcgagagaattagcaatatggtacggtaatgagtatgtgcggttgtctaatccgttaacttttgacaaccctgccctgaccgtacctgtgcgactcattccagaggagcttgaacttttcaactggataaaaagctattgcattgagaaggggatcctctgtatgaaaaaaaatgacattttacagcgtggtccgaaccgtttccggaaaaaggataaaatcaactggttactggatttactgtatgaacaaaacagagttgtaccggttattgagggaaaaacgttgtgtgtcgcacctaactttgacctctgaacgacttaatcgttgactaacatatagtctcctctgctacttgcggaggagactaatgcctttaccatgtcagcgttgtattagaaaactctggtacaggtcagtcagtaaatataactggtgtaaccactatttactattggatatcctgttgctcaggatattgtcggctttagtctgaggtgaggtggggccttcattgttttcgtattcaataaataatttaggttaattagtattattaatgggggttatgttatctgttatgttgtctctttctatcgtaatgtcactcttctttatgctgagtattctgtatgtgcgtaatgcgtctatccccatatgctacagtgtggtggtgtatggggattagttatgtgtaaattatgtcactcactcatagcgtaatattgagaaagttaatccattgagtgtgtgtctggttcgtatttaacactagttacgtaccagaacactttagggatatattatctttggttcgtacgttatagtgccgttacagtttataagtatgggtaaatataatcttttctgtatgaaataatcttcttatggtgtgtggggtatcaatagcggtgttgcctgtagctacccgatactgacttgtgtgaatgtcagattacttcctgtaagtgattgaatggtacttccttaaactcaattctatgaggtgtgtttttacctttgtaattcgtactggtcctctgtttaagagagtctcactgtattctgaagtattacctcattgctgtaatgaggtaatacaaaacagttttaacaggttgtctgtactgctggttatctcttttattaatgccgtggtacgacgtttctgtaccctcagcatttacataatttcctcttcctgtgagttttataaagtaaggactataaaatgtataatgctaaccccaattacgaaatgaatttcgcgattctgaaagatgtgaatgaatacatggaaggtctgtttcaacgtttttctaaactgttacctttcagaattgattttgcctacaggaaagacacgcccagttttggtcattcctgtaagcacagtatgtgtattgaaatgcaccgcttacttagcgaagcccaaacgatgttggcaggatattactgggtaatggaatatacgtcaaacaagggacttcatattcattttatcggctatctggatggacaacgtcacaagaactcttatcagatatccaggcaactgggggatatctggaggcggatcacggaaggggagggttattttcatctgtgccgggctaaagacaaatacccggtgcgtatcgatcacgtgattcactatagtgataaatctgcggtagacgacttacgttacgccctcagctacctggctaaacaggatcagaaagaacacggtattattctgggccgtagcaggcttcctgaaaaaagtaaccgcggccgaccacgacacaactgaattacagctgtattaggtattagaattaagtttctgtaagttgttgggaggtgcttgagttaataggcagaagagggcggggcgctttgtcatcagtgtaggggacccgaatttctgccgtggtgcctcagtggatcggatacaggtaacgaatatggttcataaatctgacagcgatgaattagctgcattgagggcagaaaatgcccgtctggtctcattacttgaagctcatgggattgaatggcgacgtaaaccgccgatctctgtgcagcgcgtttctgtattatccaccaatgagaaggttgcattatttcgtcggttgtttcgtgggcgtgatgatgtatgggcccttcgatgggaaagtaaaaccagcggcaaatcagggtattcgcctgcctgcgctaacgaatggcagttgggtatatgcggtaagccccggataaaatgtggggactgcactcaccgtcagttgattcctgtatctgatctcgtcatctaccaccatctggcaggtacccatactgccgggctatatccgttgctggaagatgattcctgttattttctggctgttgattttgatgaagcagaatggcagaaggatgcatccgcattcatgcgatcctgtgatgagctgggtgtacccgctgcgctggaaatatcccgttcacgtcagggagcgcatgtctggatatttttttcctcacgagtttcggcccacgaagctcgccgtctggggactgctgttattagctatacgtgtagtcggacccgacaactgcgattgagttcttatgaccgattatttcctaaccaggatactatgccaaaagggggatttggtaatcttatcgcgttacctctgcaaaaaagaccgcgtgaatcggggggcagtgtttttgttgatatgaatctccagccttatcctgatcaatgggcttttcttgcatcggtgatcccgatgaatgtgcaggatatagcaccgacgatattacgggctacagggagtatccatcctctggatgtgagttttatcaacgaagaagacctgggtacgccgtgggaagagaaaaaatcatcaggaaacagactgaatatttctgttgctgaaccgctgaaaatcacggtggcaaaccagatctatttcgaaaaagcgcaattacctcaggttctgactaaccgacttattcggctggcagcatttccgaaccctgagttttataaagctcaggcaatgcgtatgtcagtctggaataagccccgtgttacaggttgtgcggagaattacccgcaacatattgcgttgccccggggatgcctggacagtgctttatccttcctcagggacaacaatattgctgcagaattaatcgacaaacgatctgtgggcacagaatgtaatgtggctttcaccggaaacctcagagcggagcaggaagaggccgtttcgtcattactccgttatgacactggtgtactttgtgctccaacggcttttggtaagacagttaccgcggcggcagtgattgccagacggaaagtgaatacactgatactggtacaccggactgaattgctgaagcagtggcaggagcgtctcgcggtgtttctgcaggtcggtgacaatattggtattatcgggggaggtaaacgtaaaccctgtggcaatattgatattgcggtgatgcagtctatatccagatacggagaagttgaacctctggtcaggaattatgggcaaatcattgtggatgagtgccatcatattggtgcggtttcattttctgcgattctgaaggaaacgaatgccagatatctgcttggcctgacggcaacaccaatccgacgggatggcctgcaccccattatttttatgtactgtggtgccattcgccatatagtggcccgcccgaaggaaaacccacataatctggaggtgctgacccgttcccgttttacatctggtcatttaccatcggatgcgagaatccaggatattttcagagaaattgctctggatcatgacagaacggtggcgatagctgaagaagccatgaaagcttttgggcaggggcgtaaagttctggtactgactgaacgtacagagcatctggatgctatagcatcagtgatgaattcactgaaattgtctccctttattctccacggtcgactatcgaaaaaaaagcgtgcgatgctgatatccggactgaatgctcttcctcctgattctcctcgtattttgttgtcaaccggtaaacttataggcgaaggatttgaccaccctccgctggatacgctgattcttgccatgcctgtgtcatggaaagggacgttacagcagtatgcagggcgtcttcacagagagcatacaggtaaaagcgatgtcaggatcattgattttgtggacactgcgtatcctgtgctgctcagaatgtgggataaacgtcagcggggttataaagcgatggggtacagaattatagctgaggatgatgaaccagcgttttcattttaaggaatactttactctttttaaataatttgagctccccgagttgtacgggcaacaaagagccccagtatacaggcttccggaatatgttgtagtatcaggcttttcatcgctttaaaatgactaccggcagtaagaacgtcatcaaaaataacaatccagggtctgcatccctccagtaattgttcattcagttggtagtttgtcataatcgcttctggtgaggggcgatttgttgctgtatgagaggcaattgttgatgcgttttgcacaaccagttcccagtaatccagcatgggctcgtaggttttcgcaattcgcagaatttctgtcatacggtcatcgtaagcggcatgtatccccttggtacccggattacagctgatgacgcggattcgcacctggtggcgttactgcaacagacatgggacgccctcagtccagagggacattgcacggtggaagggtgttacagattgatgcgtacggcgacgtcaggagagagtgaaccgttcacggcgttaaagagcacgctccggtcgttgacacgtcctgtggtggcaggtctcttccgctgaggcatcaggtgttacccgtgcacacttctgggtcagggtttatccggtgacggaaacggcggtggctggtatcattaaaaacagggacccgggattgtgaagtggatgacggtgagcagaaaagagaaaaatacgcccacgccgcatgatgccgccttcagggcatttatgtcctcagcggaggtggcccgcgattttgttgagttacatcttccggcggaataccggcagttgtgtgatctgtcgacgctgcggctggagccctgtacctttgtggatcaggatctgaaacagtatgcgtgtgatgcgctgttcagtatgaagaccgtcagtggtgaagaggggtatatttattgcctcgcggaacaccagagcacggaaaacgcatttatggcattcagaatgctcagatatgcggtggcggcgatgcagcgccattttgaacagcaccatgagctgccgctggtgatcccgctgttgttctatcacggagagcggagtccgtacccgtacagcatgaactggctggactgtttcagaaatccggaacttgctgctaaaatctacaccagatcgtttcatctggtggacgtgacggtgctggatgacgacgagataatgcagcaccggcgtatgggggctctgacgctgttgatgaaacacagccgcagccgggacctcatgatgcagatggacaggctggttcaactgatacagaactcgctgaatgaagaactggcgcagatcctgttccactatctgctgaacggcagtgaacatgtgacggtaaggtttttgcagatgctggcgcagcgtctgccacagcacgagggcaatattatgacactggcagaacaactgaagcagagcgggcgtgaggaaggcattgcgctggggctggagcgtggtattgctcagggaatggcgcagggaatggcgcagggaatggcgcagggcgttgaacaaggtaagctggaaactgcccgcaatatgctgaatgccgggataaaccggaagatggtactggagctaaccgggctttcagatgagcaactcaacatgctgaagcattgactgtatgttgtcgggtgacacttcctgctctcctgtagcaggcggtggtggcttcattatattgctcagaacagggggcacctctgaatattttggagtgttcatttgtaagaccgctatccggccctgcaggaatataaatccgggggaattcacgacgtcatagacatatttccttgttaccatactgatgtggtacgtttcaaccattttggcatatcgtacttcttcagcgaccagcacccggacctgaaagccgactacattctggcgaacccgccgttcaacctgaaagactggcgtaatgaagccgaattaaccaaagacccacgttttgctggttatcgtatgccgcctaccgataacgctaactacggttggattttgcatatgctctccagactgtcggctaacgacacagcaggttttgtgctggcaaacggttcgatgagttctaacaccagcggtgaaggcgagatccgtgcacagatgatcgaaaatgatctgatcgactgcatgatcactctgctaggtcagttgttttacaccacgcagatctaggtgtgtttatggtttatgaccaaatcgaaggttgccgacccggccacaggttatcgtgatcgtcagggcgagacgctgtttattgatgcgcgtaacttcggcaccatgattagccgcacaactaaagagttaacgacggaagatattgccaccatcgccgatacctatcatgcgctggcgcagcacgccagaagaactggctgcacggattgcgcgtggtgacagcaagctggaaaaatatgaagaccaagcgggcttctgcaaagttgcgaccctgcttgatattaaagataacgactacatactgacaccgggccgctatgtgtgtgcagccgggcaggaagaagacggagtggcatttgagacgaaaatgcaggatttgtcgaagacgttgtttgagcagatgaagcaggtggatgaactggatcgtgcgattcgccaggatctggaggcgttgggttatggggaataagtggaagtggccagaattccgtttggatgaaattacgactttaattgttgattgtcctcattcaacgccagaatgggcagactagaatgaaaatcgttgctatagtactttgccataaaatcctctgaaatttgttaattagtggttaagtcacaaaatgacgtatattgtaaccctaaataccccatcaagagatgattggttaacgcaacttgccgatgttgtgaccgttcctgatgaacttctgcgtcttttgaatatagacgcggacgaaaaactgttggccggacgcagcgccaaaaagctgtttgccctgcgtgtgccccgagcatttatcgatcgcatggagaaaggcaatccggacgatccgcttttgcgtcaggtaattacctcgcaagatgagtttgtcggtgcgcccggattctccaccgatcgtaaacgtcaatacggcgttcgcttaacttaacttaacttatcgtagctggaagaaagccctatcattggtcctttcgacaaacagcgcctgaaagaagcccacaaacgcatttttaacggcatttatccatagggccggagaatacctggatgatggttaaagagtagttgggtaatcagttgccgattcaacttaactgtatgttcagttcatttgtgataatatggttatttccgaaattttcgttccattagagtatcatgcatgtctaaacatcaaactcaactttccttactgcaggatgatatccgcagtcgctatgatagccttagcaaacgtcttaaacaagttgctcagtatatactggataacagtaatagcgttgcttttgatacggtcgcttccatcgcgcaacatgccgatgttcccccttcgacactgattcgttttgctaatgcgtttggttttagcggatttaatgaaatgaaacggatatttcgccagcacctgatggaggaaacagtaagctataccgagcgggcgcgtctgttcagacagaaaaatgcggatgaaggggaacctaccccggaaaagccgggtgaaattctgaagctattttcaatggtgaatgcacaggtattacaacaattaccggtgcagattaaaaatgagcagttggatgcggcggtaaatctgttagcgaaagctgacaatatttatgtgattggattacgtcgttcgtttagcgtggccagttatttaacctacgcattgcgtcatctggagagacgggcatttttaattgacggtattggcggaatgttctctgaacagctaagtatggtcagctccgacgatgtcgttattgccatcagctactcgccttacgcgcaggaagtggtggaattagtcgagcttggcgcgaaacgcggtgcgcactatattgcgataaccgatagccaggtcagcccgctggcagcgttcagtgaagtctgttttgtggtacgtgaagcgcaggtcgatggtttccgttctcaggtcgcgtccatgtgtctggcgcaaacgttagcggtttcactggcgctggcgacggagtaaaaaaagggagcggtttgggaaacggaattttttgttaagcgaattatttaatcaattttagatcctaacgtattgatttaacgtcagtggctatcgcctttaagttatcgctcttgctatatcgcatttaggttatccgattaaggccacagcccctgaaaacgccgtatagcacgggagtacacccgagcgcgataacgcaaccgtacaatatttaatgagatggtcactccctccttcctggtactatgcagaggacaggctttcattcggagaactatcatggaaaacattgcgctcattggtatcgatctgggtaaaaactcttttcatattcattgccaggatcgtcgcgggaaggctgtttaccgtaaaaaatttacccggtcaaagttgatcgaatttttggcgacatgtccagctacaaccatcgcaatggaagcctgtggtggttctcactttatggcccgtaagctggaagaattgggacatttcccaaagctgatatcaccacaatttgtccgcccattcgttaaaagcaacaaaaatgatttcgtcgatgccgaggctatctgtgaagcagcgtcgcgtccatcgatgcgttttgtgcaaccccgaacggaatctcagcaggcaatgcgggctctgcatcgtgttcgagaatccctggttcaggataaggtaaaaacaactaatcagatgcatgcttttttgctggaatttggtatcagcgttccacgaggttctgcagttattagtcggctgagcactattcttgaggacaataatttacctctttatctcagccagttattactgaaactacaacaacattatcactatcttgttgagcagattaaagagctggaatcccagttgaaacgaaagctggacgaagatgaagtaggtcagcgtttactgagtattccctgtgtcggaacactaactgcaagtactatttcaactgagattggcgacgggaagcagtatgccagtagccgagactttgccgccgcaacagggttggtacctcgacaatacagcacgggggggcggacaacattgttgggcatcagcaagcgaggcaacaagaagatacgaaccttgctggttcagtgcgccagagtatttatacaaaaactggaacaccagtcaggcaggttggccgactgggtccgggagttactgtgccggaaagtaactttgtcgtgacttgcgctctggcaaacaagctggccagaatagcctgggcactaacaacacggcagcaaacttacgaagcatagtgagagttatatctgtttaaacaatcactcatctggttttgcggatactgattattgatgatacgaacggcccaccggcctgttgaggaacctgtgaaacggaaaggctcattgaagccgtatattttcttgaggttcatcaggcgcggaactcatcgaggcgcgggaataaaatcccattcagacgccggatagattcaagcaagcccacttatcgtcaaaatcggtgttgcaaaaacgggagtgaccatagagtccgtttcccaaaccgccgtttcccaaaccgccccctaaaaaacaagccgatgatcgtatttagcgatcatcggcattgtggtgaaacttaatcagaataacgttcggtttgaattggctgcagtttttttctgcgttttgctaacactacgctctccattttctccagcgaaatgccttttgtttccggcaggtaacggcagataaagaagtaactgaagatgcagcagatggcgaatatccacattggaaatgcgccgtggaaatgcgaaagtaaatacgggttttcattaatcatcgggaagaattgcgaaactaaaaagtttgccatccacataaatccgaccgaaatactcattccctgcgacctcatccggttagggaatatttcagaaataagcacccatgcacccacgccccaggaaagcgcgtagaaaatcataaagaacagcataccgaatagcgcgaaataaccggttgcctggctgtacagcgcccatgaggtgagcaacaagccgatgatgctgccaatagtgcctttacgcatcagcgacaaacgccccatcttatccataatcattgcgccaataatggaaccgataagctgaatcacgccgatccagattgtctggaacagggcctcctgggcgctatcggtcacatccttaaggacgattggcgcgtaatacatcatgacgttaacccctgttacctgttgcagtatagcgatcatgcagcccagaatcaggatgaaacgcacgttcccgtcgcggtaattaagtttttgatgggcgtttagttggtcgttttgcagtgaggtttttatatcggcaagaagatgtctggcatgttcttcgttggatattttggtcagtatttttagcgtctcctcctcgcgaccaatcatcatcatccagcggggagattccgggattaaaaagactaaaatacagaacaaaatgcagggaataatacccgcagcaaacatatagcgccagccaagttcaatgagccaggtatccgctgcaatcgatgctattttgtagttaacgtagaagatcagaatctgaccgaaaacgatagcaaactgctgcatacttaatgctctgccgcgcatgtttttcggtgagacttcagacatatacatcggtgatactgttgccgccaggccgactgccagtccaccgataatgcgataaatcacaaaatgggtgaacgtgtaggagagggaggtgcccactgcggaaatagtgaataacagcgctgaaaccatcaatgatttcttgcgtccaaaacgtttggataaatatccggcgctaaacgaaccaataacgcaccccaccacaacgcaggaaaccgcccagccgatctcagcaggagatagatgaaagtagctggtcagtgaaccaatcgcacctgaaataacagcagtatcgtagccaaataatattccgcccagtgcggcaatcgcgcagatgcgtaatatgtaacccgtattataacgactatttgatgtgaacataggtagattatctccagaataaacttcatctatatctatctgtttgaatttagtgaacaaatagacaaagacaaattcatcttctgtcggtcattgccgtagctctgccgacgatcttatagctattgagaactcttgtttcacaacctatgttttaatttcaaaacgttcaataatgaaacttgtgttttgttatgggtgtcacatttcgaatttcataatcctggcgttttttatcgttaagatgctgcgttttgcgcagcgccctcctgtatcttgatgaatttaattgattttattgctttcgtgacagtgcctgaactcaatttgtcaggggctgtactttttgttctttcctggaacatctccatttcgtgaacttttgcatggaatttttcttctaatgaatgcaaaaataaaatgaataatttcattggtgtgttgtttcctcaacaggcaagggagggattatgtctcagagaagtaagtacaattcggcctatgtgtacgtcctgtgttgtattgcggcgctggctggattgatgtttggttattcaacggcggtgattaccggggtagtattgcctttacagcagtattaccaactgacgccaaccgagaccggatgggccgtttccagtatcgtgattggttgtatcatcggcgcgctggtcggtggaaaaattgctgataaactggggcgtaaacctgcgcttctgatcattgcgatcatttttatcgcttcttccttaggggcggcgatgagtgaatcgttcatgatcttctccctttcccgcattgtgtgtggttttgcggttgggatggccggaacggcatccaccatgtatatgtctgaactggcgcctgctgaaattcgcggcaaagcgctgggcatttacaatatttccgtggtatctggccaggttatcgtgtttatagtcaactatctgatagcaaaaggaatgcctgctgatgtgttggtttcccagggctggaagactatgctttttgcccaagtggtaccctccattgcgatgttagcgattacgcttttcctacccgaatcaccggcatggtgcgcccgtaacaaccgcagcgaagcccgttcgataaaggtgcttacccggatctacagtggattaacggccacagatgtggccgctatttttgacagcatgaaagaaaccgtacgtccacaggacaacgtcgccgggggagaacgcaccaacctgaaaagctcgccggtgctccgctatattctgttggttggatgctgtatcgccgttttgcaacagttcacaggcgttaacgtaatgaactattatgcgccgctggtgttgcagaacagcagtaccgaagtggttatgttccagaccatttttatcgcggtatgtaatgtggtgggcagttttatcggcatgatcctgttcgaccgctatggccgtataccgattatgaaaattggtaccatcggctcaattgtcggcctgttgatcgcgtcatacggtttgtacacccatgatacaggctacattaccatctttggcatcctgttttttatgctgctgtttgccgtcagctggagcgttggcgcatgggtactgatttctgaggttttccctgaaaagataaaaggttttgggatggggctggcggtgagtctgatgtggatagccaacttcctcatctcactgttgttcccggtcataaatgataacgcctggctgcaggagaccttcggcggcgctttctcgatgtggatttttgtcgtctttaatttggtctgctatatctttatttctcgttatgtgccggaaacaaaaggggtgccgctaacagaaattgaacggctggccgagaacaagctgcgtgaaattcaggggaaacgtcgcgatgtaatagcctgatacctctccaatattagcggagaatatccagagatattctccgctggttacacaacctttactccctccagcgagtgcgcacaggatataccctgttgaaacctccccagtgtttaccacctctatgtaactaattgatccataataatatcggcaaatagggtaagtcttcttctgcatcattattttattgcgtattcctggtgggggccgtgccgtaaatacgctatatacaaaacagggaaataattttagagaaggtggatagcgatcttatgagcgtgtgtggcgcagagttgaataataaatatcctccggcatagccggaggtttttctgatgcgcctgtaaggctctcttaccagccgcgtcctaacaggcgcatacgatctgacatttgcatcaaacttcgttacttacggcccgtaaacgggctgcccgttttatcctcttcaagctggtgctttatgtattcccgtatcttcgccgtgttcttacccaccgtatcgacatagtaccctctgcaccagaactccctgttcctgtatttgaattttagatccccaaactgctcgtaaagcatcagactacttttacccttcagataccccatgaagctcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggcccccccagcctagctggggggggcatagacaaaaaagccagccgcagaggacggctggcaaagtaccactcaacgaagtgttatcgcgggtagtctggtgagttaatccacgcgtggttctcttcccaggtgaaacgccattttcgtagcgggccggccatcacgttcagatagtagttatcgtaacccgcgatggtggcaaccgggtggtagcctttaggtactttcactacatcccggttatagaccgccatacattcatccaggctgcgatcgtcggtgtagacgcgctgtaagcagaatccctgaggtggattgaaacggtgatagtatgtctcttccagataggtctcctggccttcaactgccgtatcgtgcttgtgtgcgggccaggagctggtatcgccttcattagtgtacacttcaacgactagcaggctgtcggcgagctggctatcaggaaggatgttatgcaccaggcgctgattgcgcccttttccccgatgctctaccccgacctcttgtggcgagatcagacgtactggaagctctccgaatcccggcgcgctgcatacggccagctcaaggtcggtttcggctgtcactttcgcctccgtatgatgggggaggtaaaccgaataagctggaatgcgttcaaacggactcatgcgctgaccaatccgatagaaaaaactgtcggcggccttaacgctggccagcccggcaaccagcaccagacagcgttcacgctcatcggacggcagggttatcgactctccagccttcaactgccagacatcaaaaccgacatactcccagcctgcattttgaggggaaatgtgttggatatttcccgactcagaggtacaggtactcagcaagttggccataatcttctccttcctgaaagcgtattaaccgagagttggcatactgaactccgatacgatctgctgtccgttcggccaacgcgaggtaacggttttcatccgggtatagaagcgcacgccatccggcccatggacgttcagggcgccaaacaccgagcgcttccagccgccaaaagagtgaaatgccatcggaaccggaactggaatattaataccgaccatcccggcttcaaccgactgggcgaattcgcgcgcatagtgaccgttggtggtgaaaatcacgctgccgttgccgaattcatgggagtttaccgtgctaatggcggtggcataatccgggacgcgcacaattccgagaaccgggccaaaaatttcttcacgccagatggtcatctcaggcgtgacgttatcaaacagagtgccgccgacataaaagccttcaggatatcccgccacgctatagttgcggccatccatgaccagagttgctccctcgctaacccctttgtcgatgtaacccaacactttctgttgatgagcacgtgaaacaaccgggcccatttcattttcatctttgccgcgcagctctcccgggccgatacgtagcgccgcaatcagcggtttcaggcgttcgatcagacggtccgccgtttcatcgcccaccgcgaccactaccggcagcgccatacagcgttcgcccgcggaaccaaatgctccgcccataatggcgttgacggtggcgtccagatctgcatccggcatgacgattgcgtgatttttggcggccccgaaggcctgtacgcgtttgccatgggcgctggcggtggtatagatatgttccgcgacggcggaggaaccgacaaagctgacggcctgtacgcgagggtcgctggtcaacaggctagccgcctcattgccacagtgaacaacgttaaacacgccgtccggcaggccagcctcctgcagaagctgcgccatacgtaacgatgcggacggcaccagtgcgggcggcttcaggacgaaggtattgccgcaagccagagcaaccgggaacatccacataggcaccattgccgggaagttaaacggtgtgatgcctgccacaaccccaagcggctgcattaatgaaaagctgtcaacgcctgagccgacgttaaaggagtactctcctttgctgagatgcgggatcccgcaggcaaattcgacaacctctatgccgcgcgtcagttcgccaagcgcatctgaccagaccttgccatgctcgctgacgatcagcgccgccagttcgtcccgatgcttttccagtaatactttgaattcaaaaaggatacgtgcccggcgtagcggagtcattttactccatgccggaaaagcctcatgtgcgctttgaattgccgccagcatctcctctcgggtgctctgggtgacctgacgaattactttaccggtggccggattagccaccggtagcgtctcgccgctgctgctcagtgtcgttttaccatgaataaaattgccgactgtttccatctcttttttatcctcttaaaccgatgttgacgacgttctgactgagcggtcacaggaaagcctggttatcttcagcctaaaacgcataccgtattcaatgtaaattttaggattaaaaatttcaaatctatttttatgaaattttattttgaaaatttgacgactgatttttatacgagggtatgtgcagtaagaaatcaaaaatccaattaacttattgatttttattgtttttatttggtgtgatatcaatggttgtttgttgtgatgaggaaaggtttggaaaaaattatgatctatatagcatttttgtttcattttgtgtagtataaaaattcaaatttcaggggtgtttcggcaccacagtttcggatattggagggtaaatcatgcgcttgtgcttctgtccttcagaacgagagaataagccccagttggcgtatgtgagtcaggtcagtgagagcaatggtccgtatgtccggttcatgcatatgcacccacagaccgttgaactgattcttatcaccgaaggagacggggagtatttcattggcgatcgcatctacccggttcgtaaaggcgacctggtcatttataacagccaggtggtgcatgatgagtatctggaaagcgggcggccaattggcactatttgttgtgggattaacaatatttcgtgtccgggtctacgtgagaatgcgctaataccggatgatattgtgccggttattccactgtatcaccattatgcgacggtggaaaaactgatgagctccgtgtttaccgttattaatcagcatgcggtggaagggccagcaatggcgcagctattgacccaggtagtactcaaatacattgagggaaatgtcttattgcgcacaggtaacgatgccatacagcgccatgaaaatttacttgattcaataaaatcctatattgatcgcaatttctatgagccaattcggctggatacactggcgacgaaatttaatgtcagtccttattatgtttcccatgaatttaaacgccgctatggttattcaccgatggattacctgataaaacgtaggctgggggaggctcaatcgttactaaccacggataaaggcgggcgcgaaaagatcacctctattgcctatcgtgttggctttagcaaccttagtcattttcagaattacttcaaaaataaagtggggaaaacacccggtcaatatcgcaaggactatcgtaaagctaattatttattatttgaatattaatgcttgctaaaatttaatcgtcatgagaatggtcgcaatactgcggccattttttattgttattcctaaaccacctcctagggaggtggtgattgatcctgtaaggctatagcctgaagaatgcccatgtcggaatatctctgcttactcaccacaagtaaaaggagacaaactgacatggggctttatagaagtttatcacatgtatattggcgttgcaaatatcacatagtctggacgccaaagtaccgctttaggatcctgagggataaattgggcaaggagctgtacagaaccatctatatactttgcggaataaaagattgctaaatgtacagccagatcatgtgcatcttgtcgtaatagtgccgccaaaaatctcaatatctactctgatggggcacctgaaaggtcgcagtgcaatcaggctctacaatcgattcccgcatatcaggaagaagttatggggaaaccatttttggtcgcggggttactttgtcgatacggtaggcgtgaacgaagaaattatcagacgatatgtgaggcatcaggaaaagatggaacaaacacatgaacagcagatggagttgctagagtagaaaacggaatatgacattcgccccccttatagggggcattctgaaaagccacctcctcaggaggtggtcttttacttgtcggtatattttatgcgtttatctatagcgcgaaaagtctggcaatatcattaaagagtgatgatttttttgtgatacctgacgcatttatcccacttcttcaaccaggatagataaagtttttcaggctacaaaaagtaatatgttgtccatcaaaggttaattcgcatcgcggtatgcagtaaaagcgtttcattaagtgggagccagcaacatgtacaatgtaaaaaagagcattaagttggggattgcgcctatcggttggcgcaatgatgatattcctgagattggtaaagaaaatacatataaacaaatacttagtgatgccgcgctcaccggtttttccgggacggaagttggcggttgttatccgcaggatcctgctgagttaaataaagagttaatgcttcgcggcctggaaataccaggccagtggttttcttcctttattattcgcgatggtattgcatctgcgatgaatgcttttgaacagcattgtgcttatttgcaggcaatacatgcatatgtcgccgttgtttctgaacaaacttatagtattcaaggtattatcgataagtgcgtttatacagagaagcctaacttcagcgacagtgaatggcagcttttatgcgaaggacttaatgcgcttgggaagattgccaatgcgcacgggctgaagctcgctttccatcatcatatgggtaccggtgtgcagactctgccggaagtggatcgactcatggagaataccgatccgcaatttgtacatctgctgtttgataccgggcatatatatgtttctgacggcgatgtcatgccgctactgagtaaacattttgatcgtattaaacacgttcattttaaagatgtgcgtaatgaaaaactcaaagcatgtcgcctcgcgaagaaatcattcctcaattctttccttgatggtgtgtttaccgtccccggcgatggaaatattgattttaaatccgtattagcttatctggtcgggcatcaatattctggctggattgttgttgaggccgagcaggatcctaagaaatataacccattggaatatgcgcaaaaaggtaaaaagcatattgatgagttactgaaaaattatctttaattgaaaaggaaacagaaaatgactttaaaagcaggtattgtaggtatcggcatgatcggctccgatcacttaagacgtctggccaacaccgtgtcgggtgtagaggttgttgccgtatgtgatatcgtcgcgggtagggcgcaggcggcgctggataagtatgcgatcgaagccaaagattataatgactatcacgatctgattaatgataaagacgttgaagtggtcatcattaccgcatcaaatgaggcgcacgccgatgtggccgttgccgcgctaaatgctaacaaatatgttttctgcgaaaaaccgttagcggtgacggctgcggattgtcagcgtgtgattgaagcagagcagaaaaatggtaagcgcatggtgcagattggttttatgcgccgctacgacaaaggttacgttcagctgaaaaatattatcgacagcggcgaaatcggtcagccattaatggttcatggacgtcattacaatgccagcacggtgccagaatacaaaacgccacaggctatctatgaaacattgattcatgaaattgacattatgcactggctgcttaacgaagattataaaaccgttaaggtttacttcccgcgtcagtccagcctggtgaccactctgcgtgatccgcagctggttgtaatggaaaccacctccggcatcaatattgtggttgaagtatttgtgaactgccagtatggctacgacattcactgcgatgttaccggcgagaaaggaatggcggagctgccaaccgtcgccagcgctgcggtacggaaagcggcgaagtatagcaccgacatcctggttgactggaaacagcgctttattgatgcctacgacattgagttccaggatttcttcgatcgcctgaacgcaggattgccgccagcaggcccaacgtcatgggatggttatctggctgcggttaccgctgatgcctgcgtgaagtctcaggaaacagggaataccgagattgttgaattaccctcaaaacctgatttctacaaataaaccttccgcgtattaaaaccttctgccggatagcgatgcttaagcgtcctatccggcatatcacaatttattatcttcttttatccggaacttccctatgaaaggcagactcatctcttccgatccgtatcgtcagcaattccttgttgagcgtgcggtctctttttcgcatcgtcagcgtgattgcagtgaattaatcagcgtcttaccgcgccacacgttacagcagattgacggattcggcggcagctttaccgaaggtgcgggcgtggtattcaacagcatgagcgaaaagacgaaggcgcaatttctttccctttatttttctgatcaggaacataattacactctggcgcggatgccaattcagagctgtgatttttccctgggcaattacgcgtatgtcgattccagcgctgacctgcagcagggacggctctccttttcccgcgatgaagcgcatttaataccgctgatttccggggcgttgcggttaaatccacacatgaagctgatggcttcgccgtggagtccgccggcgtttatgaaaactaataacgatatgaacggtggcggcaagctgcggcgcgaatgctacgccgactgggccgatatcattatcaactacctgctggaataccgccgccacggcattaatgtgcaggcgctctccgtgcagaatgagccggtggcggtaaaaacctgggactcctgtctgtatagcgtggaagaggagacagcctttgccgtgcagtatctgcgtccgcgcctcgcccggcagggtatggatgagatggagatctatatctgggatcacgataaagatggcctggtagactgggctgaacgcgcctttgctgacgaagctaattataagggaattaacgggctggcattccactggtataccggcgaccatttttcgcaaatacagtatctggcccagtgcctgccggataaaaaactcctgttttccgaaggctgtgtgccaatggagagcgatgccggtagccagattcgccactggcatacctatctccatgacatgattggtaatttcaaatcgggttgtagcgggtttatcgactggaatctgctgttgaacagtgagggtgggccgaatcatcagggtaatctgtgtgaagcgcccattcaatacgatgcgcaaaacgacgtgctgcggcgtaaccactcctggtatggtattggccacttctgccgctatgtgcgtccgggggcgagggtcatgctttcttcaagttacgataatcttctggaagaggtgggatttgtgaatcccgacggcgagcgtgtgctggtggtgtataaccgcgatgtccaggaaaggcgttgccgggtgctggatggcgataaagagatcgcgttaacgctgccgccgtcaggcgccagtacgttgctatggcggcaggagtcgatctgaatgatgaagctgggatttaatgaagcgacctgtatgcgaaactccacgctggcacaggatgttgtgttggcggaacgttttggctatgactacattgaaatccgtctggatatgttgcaggagtggttgcagaaacatacgttaagcgagctggcagacattttcgccgtcggccatcttaagccctggggctacaattcgctggaagacattacgttttgtgatagcgaaagctgggcggagaaacggcggcagttggctttcgcctgccatgctggctcagtggtggggggggattgtctggttgtggtgcccaccattcgtcaggggggaaattttccgccaggggaaacggtgaaagattcagtgaagcgtctgcgcgagatggcggcagtggcggaagaaagccagatgcggctggcctttgagccgatcggttccgcaggatgctgtgtgcgcagtcttgccatggcgatggagatcgtagatgcggtcgatcgcagtaacgtcgggctggtcgtcgatgcctttaatctttacctgcacgatcaatggcgggatctgaccacgcttcgccagatccctgtggaaaagatcttcgtttaccatattgatgacgccgataatctgccgctggcaacgctggagcattgccatcgtctgtttcctggcaacggcgtgatcccactgcatgagatcacgcatgagctagtgcagaagggctatgaggggatctgttcgctggaactgtttaaccctggctactggcagatggcggccagcgaagtctttgcgataggggcggaaaagactcgccccttcttagcagcttaatgttgccgcagcaggagatggacaaccgccgcgcccagcagcgcgcaggccgcggccagaagaaagacctgctgatagccgataaacggcgtcagcaggcccgctattggtccggtaaatccgtaggccagatcctgaaacgctgaccagacgccgagggccgtaccacgaatctccggtggcactctgcgcacaacctctacgcccagcgatgggaacatcagcgaacagccgcagccggtaatcgccgcgccaatcagcgcagcgcctgctgacggagcggaccacattaccgccagtccggtcccctctaccagtagtgaaaaggttgcgaccgtggcgccgccgtaacggtcgggaaatttggcgcagaaaaagcggacagcgataaacgcaatgccaaatagcgtcatcgcaaaaccggtgttatcccagtgacgctcgttgaaccagagggcggtaaacgcgcttagggtggcaaaaccaatgccctggagcacaagccctgttccgggccgccacaccaggccgactacccgtagcactggcacgcggggacgggctgttgggatattccccggaatgccatagatgactcctctggcgatgatcggcaacagcacgacgaggagcgccggaagcgccaggccggccctggcgtaaagcgacagccccagcggcgcgccgatagccagcgcaccgtaggtcgccatgccgttccaggaaataacctgacccgcgtgggtcgagcccgccagccacatcccccaggttaaattaccggtcaaaatgaaactttcaccgatgcccagcagcacacgaccaacaatcagtatggcccatgcgagcagcggaaccgggtgagcgattagactgaccagcatcagcagacctgatgcggcgcagtagaactgaccggtgataaccgtccgacgtccgcctgacgtgtcggcttttcgacccgcggcgccccgggtaagcaaggtggcgataaactggctgcctaccgcgataccgatcaacagatcgctcagatgcaactgctgctgaacgtacagcggcagcatgactaacgggatgccaatagtcagatagttgagaaacatcgcggcgctgatgcgaaacagcgtgatcgatgtggaatgttgtgtgagagctggcatggaatcgtccttgatcgataggaattaaaatccccaaaagactaaaaaaaacaccacaaaacggatattacttctacatcctttgcgcaccatataaacgaaaatgacgattaaacaggatgactctgattgatacagagtataaatggcgattttttgctccgttccccaaaaaatggacacaacttcacctctgcggctctcagccgcacacccgctgtcgtgccagtggctcatgcatcatgaccagctctgccagtcggtagccacgcttcaggcccgtaaaacgcatctgactcccgcacagaatgcacttcagcgggtcaaccttcagtaaccgctgatacatccctctccacctgatttgcatcgccgtttttcgcaccgtctccgttatggcatacacaacctcttccagtaacgggcgcttcaccggactcaggaacccgtagtacctcaccatccggaatcccttatccgccacatgccaggagaacctttccatgaactcatcaccgctcatcacaaggtattcttcccgttttgtccggtgactgttgtaacgcaggccagtttcatcctgacctgcataatgctccagacgactcatcggaaccggcggctttttgaggtaagagccagagtacaccgccacgtgggtggcgttatccattaccctggagacgttgacattccagccccggcagtgatgtgtgtccaggaggcgattccagtcccgtttgctgtttccttccgcggtcagctcatccggtatcaccaggtcagggtattttcgtgacagtaaccgagttatccggtaacgccacatactcatcaccttacgggcgtaaaaatgaagatttttccaggtgtgacctgatgtcacaccaccggcagttgtcgataaatggatatgcggatgccactgctggtctcgtccccaggtgtggattaccgtgaatattcccggctacacatctgcctggcggcagatttccagtatcacatccgctgcgatatggctcatctctgccagtaaccaccggttgtggaacaccagggaccagtactggcacggaagcgtgaacacaatatgctgccacgggcagtcggggaccagactcagcagatactgtatccactgtgcgcctgcttttactccgcagtgcggacaggaacggcttttacaccggaagcagaccttctttgtgtggcaacagtccggtgacgaacagcaccattgcgtgtaccccatcagcgtggtcccacaggccatgatttttgtcactgactcaatcaccaccggacgcacggaaccttccggctgtttctccagccagttaagccagcggttaccatgctgaaaaatgtcggcaaaacggggaagcatgaattacgcagggggaagatgtgaggtgccgcacagcggacagataaagggatgtatcgtgcacacggacagaaaatttttccatgacatggggagcatggtgacattaccgtcgggctcaccgactatccatacggttgtttcataattgccgctggcatcttcttcaaacaggcacggaatatctttctccatacagtaatcggcagcgctggcgaagtcgggaaaaaacagcccggcttcattatctgttcctccggagcaggggatcacccgccatcgcaacaggggagctgagcgggtggattgtctgctggatttttgtttgcgaggtttagctgaacgggccatataactacctgaaagacaatgatattgtctgtttttataacggtaatatcaggtcatgacaagccgcagccgccaggctgcctactcgaacacgccccttgtccgatgcagacacggggcgtgatgaggcaggcattaacgtgccgggcggtattcgcgccagtagtcaataagcatgcggtatttttgtttcaccgttgcgatgagctgttcatcgttaagctggccgcctaaccactggcgtgacggttcgccaaagatggtccggccgacggcgaaacctttcacccagggcatatccgctgctgcggcgaatcctgacttcaactcgctttccggtgcgtccaggccaagtatcaatataccgcgacattcagggtcataatgctcaatatgctggctgatttctcgccaacgatctgggcttaacggtggcagtttccaccagtccggcaggatccccagttgataaaaacgttccacaatctgaggatagtattgctcattttggtctgccgtatcgcgcggcaagatgacttccagcagcagatcgtgaccagactggcagcaggcgcggtaaacctcgtcaatgagcgcctcttgttcaagacgtaccgactctgcatcgagtggatgatagaagaccagacatttcacgacgtgctcttgcggccagctgacaagctgagagccaatatcgccatgttccagcttcagcggatacgaaccgggcatctcaaccggtcggccaatccaccatccctggccggtcacgtcgttaagcgcctgctgaccaaaggtggtatcggcaaggatgccgctattattctgtaaaccggcctcaagcgccgcctgacgcgccccttccagcagtagcatcttcagaggggggatcgcggattcactggcgccgacttcatttgcgatatccaccagttgcttgcgatggtcgaaggcgaatacgcacagctccggccagtgctgtttacgggttgtgacccgatgaaggtgattcagccgcgggtctttgtctggccgggtgatggattgttcacgcgcgaggtagtcgtccagctcttttttggttggcatggcgggggcacaaccgtggcgcgataccactaacgcgccgcaggcgtttgcataacggcaggcttgctcccagctttcatcgttcaggtatccccgcagcagtcctgacataaaggcatcgcccgcgcccagaacgttcagaacgtctacgcgaacgccgctatgtatcttcacctgcgaccagtcatcggcaatgttgccttcaaagactgagcagcccagcgcgccgcgtttgcacaccagtacggcttgggtcaactgacggacgcgccgcagggcggtcagcgtgtcggtactgccgccggcgatatggaattcttcttcggtcccaacgatcagatcgaaatggcgcaatacctgctggagctgttcggtaacctgtgatgaggcgatgaaacgcgtttcaccgtctcctagcgacgtcaggccccacagtacggggcggtagtcgatatccagcacccgccgcagcccgtgtttttgcgcatactccagtgctttaagaacggcggcgcgcgtattggggtgagaaagatgggtaccagtgacggctaatgcgcgtgaagaagcgatgtaatcttcgcggatatcctcgggtgttagcgccatgtccgcgcagttatcgcggtagaagatcagaggaaaggtgtcctgatctttaatgccgaggatcaccagcgcggtcagacgatcgcgatccgacagcaggcactgcgtatccacaccaacgcggtttaattcttcacgaacgaaacgtcccatatgctcatcgccgacgcgggccagcatagcggaacgtaatccctgaatggccgtgccgtaggcaacattgcctgacgatccccctaaatatttagcgaaagtcgtcatatcctccagccgcgacccgatttgttgaccatacaaatcaacagcgactcgtcccagacagataacgtccagcggcttttgctcactactgactgctttattcattgacatatcccctaacagaagacggtgttatttttgcttatactaaggtttggtgatttcattttcaataaaaatggaatgacgttttcatttattgtttgaataagatcacagaaatggcatttccgggcaacgggcatgatcgttttttgttgtgttttttgttttaattggttgattataaatgttttattttttaaaagcgcatggaagataaatttcagtttcatgaaaaatacgcctgaatgtcgaaatttttttaccgttttttgatctccttcccataaacgaaatgtaaattccatataattgtgagaacggaaattttgatcctatgataagtctctgtgtttttggggctgaagcgatgcataagcaggcaacgacagccgaacggttgataaaagcaggtggggtacatgaaaacaatcaggttgaccatggcgcaggctttggtgcgctttcttgataatcagtacatcgacgtagacggcagcgaaatcaaatttgtaaaagggattttcgccatttttggccacgggaacgtcgttggattggggcaagcgctggaagaggactgtggccaacttagcgttcatcaagggcgtaacgaacagggaatggcgcatatcgcgacgggatttgcccgccagatgcgtcgccatcagatttatgcctgcacctcctcagtggggccaggggccgccaatatgatcaccgcagcggcgaccgcgacggctaaccgtattccactgcttttgctgccgggagatgtgtacgcatctcgtcaacccgacccggttttgcaacaggttgaacaagaacacgatctgacgctgagcaccaatgacgctttccgtgcagttagccgctactgggatcgcattacgcgtccggaacagctaatgagcgcctgtatcagcgcgatgcgggtgttaaccgatccggcggatacgggggccgtgacgctttgcctgccacaggatgtgcagggtgaagcctgggattatccggattattttttcgctcgccgggtctatcgtcttgagcgtcacgcgccgacggagccgatgctgaacgaggcggttgcgctgattcgccgccaccagcggccgctgatcgtttgcggtgggggcgtgaagtattcgcaggctgaagaggcgctgctgagatttgccgaacgctgtcatctgccgattgctgaaacccaggctggcaagggagcgctcagttctgcacacccgttgaatgtcggcgggattggcgaaaccggttcactggcggcgaatctgctggcgcaggaggccgatctgattatcggtgtggggacgcgctataccgatttcaccacctcctcaaagtggatcttccagaatcccgacgtgcgctacttaaatatcaacgttagccgctttgatgtcttcaagctggatggcgtacagatgcagggtgacgctcgcgtcgccctgacgcagcttagcgaacggctggcccaggagcattatgcttcgcaatggggtgagactattcaccgcgtccgctcgcaatatatggcggaagttgagcgcgtctatgctgtggaatatagcggagagggcttcaaacctgaaattgaggatcatatggatactcaaaaggtgtttgaagagtttaatgagattacgcgatcgtggctgacccagacgcgcgtgttgggcgtgcttaaccggatgttgccggaaaacgcgctggtggtggcggcggcgggcagcctgccgggcgacctccagcgtgtctggcaaagccgcggagagaatgattaccacgtcgagtacggctactcctgtatgggctacgaagtcaatgccgcattgggggccaaactggcgcagccggagcgcgaggtgtacagcttcgtgggcgacggttcgttcatgatgctgcactctgagttggtcacttccgtccagatggggaaaaagattaccgtcattttgctcgataacatgaccaacggctgtatcaataatctgcaaatggaacacggtatggacagttacttcaccgagtttcgtttccatcagcaggagagcggtcgtcaggaaggcgggtttatcccggtcgatttcgctcgcatcgctgaagggtatggctgtaaaagctatcgcgtcaccaccattgaacaactgcatgaagcgttggaagatgctcgtaaacaggccgtgagcacgctgatagacataaaagtgcttcccaaaacgatggtgcataagtacctgagctggtggcgcgttggcggggcgcaggtatcccgtagcgaacgtatccaggcggtagcgcgtatgcttgaggaacatatcggacaggcccggcagtactgattaatttgccgtcgttcaggttgcagaagtgtggttattgttctgcaacctgaacgatacagcgtcaacgcattgttttcttttcagaacggcaaaataaaacgatccgtttttcgcagaattacggatgcttttcttttgcggttttaaatttactattcatgagattaagaggtacgaatgaaaaagcttcgatgtggtgttattggccttggtcgggtaggtaaaatgcatgttgaaaatatgtatttactgcctcaattagatattatctgcgccgccgattattttattgaggagatgagcgattggctttattcggtaaatataacttcagggtataaaaattatcaggaacttttacagcgtgatgatatagaggcagtttttattttcacctcaacggatatgcacgaagagatcgtcacggcggcagcgcaggcggggaagcacattttttgtgaaaaaccgctcagcatgaatgaagatgagcaggcctcaatggcggtgctgagaaaagtgaaagagaagggggtgacgctgcaggttgcctttaatcgccgttttgatcctcagtttcacgaggtctttgagctggtgcgcagcggcaagattggtcggccccagatgataaaaatcacctcccgcgatccggacctgctaccccatgatctgatcaaacgtattggcggtctgatttttgacttcaccatgcatgactttgatatggctcgttttatgatgcaggatgaagtcagcgaagtctatgttaagggcaatacgctgattgatcccagcctgaaaaatattgatgatgttgatacgcttgcggtgatgctgactttcagaaacggcggctacgcgctcattgataacagccgtcgggcggtatatggctatgaccaacgggtggaggtttttggctcagaagggatggcgtatgcggataacgttagtgaatcgacggtgaaagttttcaacagccagcactgcataatgaaaaatcctcttcctgatttcacggtccgttatcgcgaagcttaccgaacggaaatattacactttattgattcagtcctgcatcatacgccggttgtctgtaccggcgaagacgcattattggcccagcgtatcgctattgccgcgcagcaatcattaaaaagcgggctgccggtgaaaataacaagcgatatttatctttgactgcatctgttaataatgaataaactctcgcactgaaaagtgtgagagcttttctataccgaggttaataaaatgaaagaaacgcaggcaacgctgccccagacattttatataaaaccaggtaagtttatctggagctacctgggaacatttttatttatgttgggcggctgtattgagaacagctggttatctgcctggttaaatacgcagggatttgatcaggagcatatcgggcagatttttgccgggtatgggattgtggtcgcgatcacctcttggctatccggcgtctgtgtggacgtttttggtcctaaaaaggtgatggttaccggttttatcgtctatcttctggcttccgtcgcgtttctgaactttgcgctacccagccatgattttggcgccattctcgtgacctatatgctgcgtggcgtggggtatccgctggtttgttactccttcctggtacgcctgaccatccagttggataatcaccagcaagggatcggcacctcgctgttttgggtggtctataaccttggttttaccatcattgggccggtggtggcggcgtcgttaattcctgcgttggggcatatcaacgtgatgtgggccgggatgggcgttgcgctgctgggggttctcttcatgctggtgctggaacgcaatgaattcattctgaaaccgcgcacgacgccggtcttcaaagagttatctgcgggtatctccattatgtatgaacggccacggatcggtctggcggtgattgtcaaaactattaacggtcttggcacctatggttttgttgtcgtattacctctgtttctgctggataagcactttacgcttgaggaatgggcgagtatttgggggattacctttatctctaaccaggtcttcaacattatctttggctggatgggcgataaaattggttttcgccgaaccatccagatttttggcagcatcctgaccggtgtcgctacgctgattgtttactgggtgccgatgatatgggggcataactatgtcgcctttatgctggcgatgtgtttgtggggagccgggctggctggctttgtgccaatgacgccgctggtgccgatgatggcgccggataagaagggggcggcgaactcggccgtgaactttggctccggcctggggaatttcgttgggccagcgctggtctccgttctggcagggttcggcaccggcgtggtgatgtatactatggcggggctctatttattcagcggcattctggtgcagtttcttaaagtgcctggcgaaaaatagcttcaaatattcttcaaaaatcccttatagcctgtgatgttcatcactaaattaaaccggtttttatcaagattgataaagccggttttttcaccctacgttaaattgtactaacggattacggttatttacccactcatatacgttcagggagaaaataatgaatatcgagaaaacacggttttgtattaacaaatggtaagcgtacagcctgaaccgtctggtcagaatctgacgaattagacaaagtggtgtccaccaaataagtagtgggaaccaaagtgtcagatatgcagaaaaatgtgactcccggcaggcgaaaaggctgccctaattatcctcccgaatttaaacagcagctcgttgctgcctcctgtgaacccgggatatccatctcaaaacttgctcttgaaaatggcattaacgccaatctgttgttcaaatggcgacaacaatggcgcgagggaaagctgctattaccttcttcagagagcccccagctacttcctgtgactctcgatgcagctgccgaacagccagaatcgctcgcagaggacccggaaaccctcagtatcagctgtgaggtaacgttccggcacgggacgctccgcttcaatggcaatgtcagcgaaaagctcctgactctgctgatacaggaactgaagcgatgatcccgttaccttccgggaccaaaatttggctggttgccggtatcaccgatatgagaaatggcttcaacggcctggctgcgaaagtacagacggcgctggaagacgatcccatgtccggccatgttttcattttccggggccgcagcggcagtcagggtaaactgctgtggtccaccggtgacgggctgtgcctcctgaccaaacggctggagcgtgggcgcttcgcctggccgtcagcccgtgatggcaaagtgttccttacgcaggcgcagctggcgatgctgctggaaggtatcgactggcgacagcctaagcggctgctgacctccctgaccatgctgtaaatctctttatcctggttgtcacagaataagcccggtaaaatacgggcttatgaacgacatctcttctgacgacatcctcctgctgaaacagcgcctggccgaacaggaagcgctgatccacgccctgcaggaaaagctgagcaaccgggagcgcgaaatagaccatctgcaggcgcagctggataaactccgccggatgaacttcggcagtcgttccgaaaaagtctcccgccgtatcgcacaaatggaagccgatctgaaccggcttcagaaagagagcgatacgctgactggtagggtgtatgacccggcagtacagcgtccgttgcgtcagacccgcccccgtaagccgttccctgaatcactaccccgtgacgaaaagcgactgttgcctgcagcgccgtgctgcccgaactgcggcggttcactgagctatctgggcgaggataccgccgaacagctggagttgatgcgtagcgccttccgggttatccggacggtacgggaaaaacatgcctgtactcagtgcgatgccatcgtgcaggcacctgcaccttcgcggcccatcgagcggggtatcgccggaccggggctgctggcccgcgtgttgacctcgaagtatgcagagcacaccccgctgtatcgccagtcagaaatatacggccggcaaggtgtggagctgagtcgttcactgctgtcgggctgggtggatgcatgctgccggctactgtcaccgctggaagaagcgcttcaggactatgtgctgactgacggtaagctccatgctgatgacacgcctgtcccggtgctgttgccaggcaataagaaaacgaagaccgggcggttatggacctacgttcgtgacgaccgtaacgccgggtcaacgctggcgccggcggtgtggttcgcttacagcccggacagaaaaggcatccatccgcagacccatcttgcggggttcagtggtgtactgcaggcggatgcatacgccgggttcaacgagctgtaccgggatggccggataacggaagccgcctgttgggctcacgcccgccgtaaaatccacgatgtgcacgttcgcaccccgtcagccctgacggaggaagcgctgaaacggatcggcgaactgtacgccatcgaggcagagataaggggaatgacggcggagcagcgccttgccgaacgtcagttgaaaacgaaaccgctgctgaaatccctggaaagctggctgcgtgaaaagatgaaaaccctgtcgcgtcactcggatacggcgaaagcgttcgcatacctgctgaaacagtgggaggccctgaacgtgtactgcagcaatggctgggtggaaatcgacaacaacatcgcagagaacgccttacggggtgtggccgtgggccggaagaactggttgtgtgtgtcacgaaggagaactgatagcggcaatatgaaaattgcagcataagttatccatgctctgaggtgggtggaggtgggccctccggtcagggtttgcaggaacactgaccaaacgacccggtgctgcttcattctaaggaatgtagtggtgagcgactcgggaaaaggcagagatctactgtcacgtggggttcgggaagctgaacgaaagtaaactgtccgatgaagcatcgaaatcttagatgatgtcaaaatggggccgtacagccgtcctctgataagcgcagaagacacctgcttactgactgcgcggcatccggtgttaaggcagcaggatcccgggccagaccatctcagggaacgtgagaacctgtttccggcacgtatcgggaaacaggggcggacccattcgtagtagtgatgaaagatctgtaatgggtctggagcgaagggatggggatcacattcattgcaaaagacacaacccataaggggatgatgtaactgatgcaacgaaaatcattcgaaataccaaaagcactggtctgggcatcatatctggatgtgcgtcgcaacaagggagcccccggatgcgacggacagactttgaaaatgttcgaccagcaacgtgatggcaatctatacaagatctggaaccggctatgttcgggaacatggtttccgccacctgtgctggaaaaacggatcccgaagccgaatggcaaggagcgcattctggggatcccaacagtatccgatcgaattgctcagggagcgataaaactttttatggaagaaaagcttgacccgattttccatgctgattcttatggttaccgaccaggcaaatcagctcatgacgctctgaaacaatgtgccatccggtgctggcgttatagctggatactggaagtggacatcagtgcgtttttcgaccatgtgagacatgatctggtgctcaaagcactggaacaccacgggatgcctaaatgggtcatcctgtactgtcgacgctggatggaagcaccaatgcagagttgtgaaaatggagaattaataacccgaacacgaggcactccgcagggcggggtcattagtccgctacttgctaacttgttccttcactatgcatttgatttgtggatggaaagagaatatcggggggtaccgtttgagaggtacgctgatgatattgtagtacattgttcacgaatgagtgatgcaacaaggctgaagaacaggttatcggagcgcttctcggaagtcgggctggtcctgaatgcagggaaaacgaatatcgcctacattgacacgtttaaaaggagaaacgtcgcaacgagtttcacctttctcggatatgacttcaaagtgcgtacgctgaagaatttcaaaggcgaactgtaccgaaaatgcatgccgggtgcgtcaaatgcagcaatgcgcaaaataacagaaacaatcaagaagtggcgtatacatcgctcaacagctgagagtttgctggattttgcgaggcgctacaatgcgatagtgagaggctggatcgagtactacggaaagttctggtccagaaatttcaactatcgactgtggagtgcaatgcagtcacgtctgctcaagtggatgcagtctaaatacagactttcgaaccggagggctcagcgaaagctgacgctggtaaggaaggagtatccgaagctatttgtccactggtatttactacgtgcatcgaatgagtgatcaagagccgtatgacgcgagagtgtcacgtacggttccgtgagcagccggggagtgaaattctctccggctgactcgactcgcgggttccgacagcggtggcgaacatgcggcggtgttgtactcgctgatcggcacatgccgtctgaacaatgtagagccagaaaaatggctgcgttacgtcattgaacatatccaggactggccggcaaatcgggtacgcgatctgttgccctggaaagttgatctgagctctcagtaaatattaagacggttctggcgagccgcttactattgtagtggcatatctacagaagccagattggttacggccatcttaatatcgaacagtgtagaggatttgtgaaggaccactgctggctgagccagataatgatgcccgaatccctttacatactcgtaacgcccggtaaggcgtaacatatctccctctaattccatccatgcttcatccatcgcggcacaggccatttcaccgtgtagcagatgagtatcttccgcagatgggcagccattagccagcaaacctgaatgaaaggcaaaacagccataggtttctatcacctctgtcgccggtttaggctggcgaaacatattgcacatggtgagactgtgtccatcaaattgcgcatcccaaatcatctgccccatccagggaagaataattaaatgtccacgactgtttgcaattttaagcccctcgacaccgctgtcatatcgaaaagacgtgacagtaaaatcactattttccagcaagatacgaggtttttcgccaaaaagcgcccgccacaaataaatacgcgtactcataacgattctcctcaggactctgtgacttcagccagtgcattacgtactttgctttcacgccagaagtagacaccgacatagacaaaacagagcatagaaaccaggaatgaaagctgtagtgagtggaacatatctgcaatatatccctgaattgccggaaccaccgctgcgccaacaatagccataacaatgactgctcctgccatttctgtatgttggttatcaactgtatccagtgttcctgcatagatcgtcgcccagcaagggccaaacaaaacacttaccaggacggcgacatagaccgcactgaaacttggagccagtgcaacatatgccagaaacagcgcccctataacggaatagagaatcaggactttttccggattaaaacgtgtcataaggatgttggctataaacttgccaataaagaagcaggcaaagctgtagaccatgaagtttgaagcatcacgttcgttgatatcgcccaactccagcgccagacggatggtaaatgaccatactgcgacctgcatacccacataaaggaattgagccacaataccacgacgaaagcgcggatttctagccagatagcgcagcgtatccattgctgacgggcgtttatggtgacttgtctgtgccactttacaggttgggaagcgggttaaaaggaacaacaccatgaccacaaccagaatcataatcatatacttatacggttcaagggtgttctctaacatcagcaccttaaagttgtgaatttgcccggcgttcattccggacatctgcttctcaaggctttccccctcggagaaaaccagatatttgcccaataaaataccagacgcagcaccaatcggataaaaggtctggctgatattgagccgcaatgtagcgtaggcttttggaccaatcatcgaactgtatgtgttcgctgcagtttcaaggaagctcaggccaatcgcaatcgcaaaaatagccgcaaggaacatagtgtaggttgccatatgcgaggcagggaaaaaaagtgtacaaccaccaatatacagcgtcaggccaattaaaattgccaccttataactggtctttttaatcacaagggatgctggtattgcaattaaaaaataacctccataaaatgcgctctgcaccaatgctgaagcaaatttacttagcgaaaatacacttttgaattgagtgattaatatgtcatttaatgcagctgcgcatccccatagcgggaataaacacgataacaaaataaactggaacaagggggtcttattcagatacccatcaggcatctgaatgatgtttttatcgttcatagtgctacctttaactgtgcaggatgattattcgtttaaggttaaaaattcattaaattgttcaatactcggataagatgattgcgtacctttccctgtgacgctgaaagcggcaaagagagcggcttttttcaaagcggcttcaacatcaccgctttgaacataataatgggaaaagcaaccaataaatgcgtcaccagcgccactagtatcaacagcatttactttgaatgcaggaacatggacttcctgatcacgggtcatccataatgcgcctttttcgctcatggtaacaataatattgttcagccctttatcaactaacgaacgtgcggccaaacgaatatgatcataagtatcaaccgacataccggttaatatttccagttctgtttcatttgggataaagaaatcatatttgcaggcataagacatatctaactcacgcaatgccggagccggatttaataacacttcaataccatttttcttaccaaactcaatcgcgtggtaaactgtttccagttgaacttccagttgtaaaacgatcaatttgcattttttcagatcttctgcagctcgatcgatatcttccggggaaagaaatttattcgcccccttaattattaaaatactattgctcgagttagcattaacaaagatcggcgcaacaccactgctggtacaggggactttctcaacataagtggtattaattccccaagattcaagattacgaatagtattatccgcaaaaatatcatcacctactttagtcagcatcaggacttttgaattcaatttagccgccgccaccgcttgattagcacctttcccaccacatccgattttgaaggcaggtgcttccagagtttctccttctttaggcatctgattagtgtaagtaatgagatccaccatattggaaccaataactgcaatgtccatttcactacctcttataaactttcgcataacaatggtatttaaataacattggtatgttacttttgcatcatttgtgactgagatcgcgattagcacatcaacccgatgtttatttaatagacttccagtcttatcactcaggccaacactatctaatcataagcaacctaacaggattaataccgaaaattcagcaggctatacccttttcatttcaaagggtcggtcgtatagtatggtaactaaaacaatgtttactaatgccataatgttatttttataacattttacggagagagttgatggaaacgaagcaaaaagagcgtatccgacgtttgattgaaatacttaagaaaaccgacagaatccatttgaaagacgcggcacgaatgctggaagtttctgtaatgactattcgtcgcgatctccatcaggaagatgaacctctgccactgaccctactgggtggctatattgtaatggtgcataaacccgcaccatccatgccagtaatccaggacgttccgagaaatcatcgtgatgacttacctattgcaattctggccgccggaatggttaatgaaaatgatctgatcttctttgataatggccaggagataccgctcgttataagcatgatcccggatgcaatcaccttcactggcatctgttactcacatcgtgtctttgttgcgttgaatgaaaaacctaatgtgacagcaatactttgtggtggtacgtatcgtgccagaagtgatgctttttacgatgccagtaactcttcgccattagactctctcaatccgcgaaaaatatttatttccgccagcggtgtacatgatcactttggcgtcagctggtttaatcccgaagatcttgccactaagcgtaaagcgatggcccgtggactaaggaaaattttgctcgcccgccacgccttgttcgatgaagtagcctctgccagcctcgcaccgctctctgcatttgatgttctgattagcgagcgtccgttaccggcagattatgttacgcactgccggaatgcttctgtaaagatcattacacctgattcagaagacgaatgacttactgaaaaaacaccgtactcttgttaaacatcgtcggattggactgattacgttgcactttcatcacatattccagtttatcaatttggcttatcatctactccagacgctggtcatcattgaccaatagtctgatatggcttttgtcgctgtcctgaatcggcaggcagaaaatgccttcaacgttaaaagcacgacgggaaaaagcccacaaaggtgagtcattacgcccggataataaacaggctcctccctgttatggaagccgttgtattgtccataatgtctgggtttttaatgcacactggataacaaccggacgaatcttcaaatattactggcgctgacagccggtttgaattcatctcacaaccctgcatagagcgaatctcctgcctgcacgtcactccactccatggtatcaacttcacactctttatctgcggctagtttcagtcaccagataagcctgccacttgttgcgatcggtaaagggctggtgataaatccagaatgggtgactttagctgaatcaggtagaagtcatgaaattcaaacagcccttaatccacaacgcgttcctgaattaaccattctggataaactatgggatcaaattcaggcatcgaaaggaactggctggtttccgttaatggattaaatatcgattactctcccgagagtaaaactatcaaatcaatgagtaaccgatacagcctcgcaaattctttcagataattaacccgtcactgcggcacgttctctcgtaaggcgtgcctgcagtgtaatccagtatgtatccggcatagttgacggtttaatagaactcaactcctctccctggttacctacaacgatatcttgtataacaccccaggagatacgacgttacgatgagatgcgatatgctcctcagcgccaatcaacgccaggactgggccagtcttgagatcagactcattcccgtaactgatttcaggcgacatatatcaatgacgttggggcaataaaagatagccgatgtaatacatctattcaaatttgtgatacatgtcaaaaaattggttgaccaaactcgttatttatataagggcacttacgaagtgcactcttttttaaagcgaggaagtaccaatgaaagagaataaagtacagcaaatcagtcataaactgattaatatcgttgtttttgtcgcaattgtagaatacgcctatttatttctccatttctattaataacggcaataaactgttcacttcagtgatatttaaaatatgcatcctctcccttttttgtaagtaattattatatccgtgggagaggaatacacattgtcaggtaatcaatcatgctgcaataaatcatcggccagtaaagtggagatagcctccattctcgaaaaatccatactctcagcgaaaccatcatcaatcactcatccaggcgtttatgggagcgtcgccaatggctgctaacaatgccagacttccccgttgcggaaattccacatcccacaaatagtcacagtgattgggtgttgaaatgatccggatgagcatgtatctttacggttatgttataacataacaggtaaaaatgatgaaacccaatatccatcctgagtatcgtactgtggtgttccacgacaccagcgttgatgagtactttaaaatcggctcgactatcaaaacagaccgtgagattgagctggatggcgtaacgtatccgtacgtaacaattgatgtctcttcgaaatcgcacccgttctatacagggaagctgagaacagtggcatcagaaggaaatgttgcacggttcacccaacgttttggtcgttttgttagcacgaaaaagggggcatgatgaaagtccttaactctctgcgtaccgcaaaagaacgccatccagactgtcagattgtgaagcgaaaaggacggctgtatgtgatttgtaaatctaatccacgttttaaggccgttcagggtcgtaagaaaaaacgttgattcaaaattcgacgaattaacgatatttgtctgattaataatcagaccggattaatgttggtgtatttattacaccagcattaattttcctggggatgtatcttcctgttcatttaaggtcaactgcctgacgtttctctccgaatattccattatattaatgttgacttgttgaccagtttcgccctgtatgctggcatcaactctattttagactgaacacgccactcagtttcctccctttgcgacgcagcctgcatttacactcaaactgttaagatgataaatgtggtaaatctgttggtactgacataaaaacgtttacgccacaggaacggccagatccatcggtaaccccatcgccgacgttcgagtgccagttagagtaacacgcacagatgactgaatgcagtgccctggcaaagaggccatcgttcctgtgacaactggcagtcttcgtttaacttcacttaatttggctcttagggggcttaccggacagatgacgtacttacacctgtttaatttttcatcacttattgggatgaacacccataaccattttgtgcggcatgttaatccattaaaacaccttactgattggtaaatcatctttaattatgactcatgatggttttatattctatttcttatcatttaaacttgtttttttactagtccattacacaacacattaagactattcctaacacctcagggcaaagttcctggctaatataaaatgcaagtaagaattgaacgttatattgccaataaccttatgaaactgaatgtctttttcttcttatcaaaaaagcaatattttcattttttgtaaatattgacttaaccatggaattcattttctgttcacatattgacactcatcaggaaaaaaacataaatttaaacctaatcgaaataattaaaacttaatctcgtttaacctatattgatatgtgctacgtatcttatttacttccgatttactaaagaaactgaatgtacctgtaaaaattacaggtttggaaagtagtgacatggcaaaatgattacagcagggactatgaggttaaaaaccatatggaatgtcaaaaccgttctgataaatacatctggtctccccatgacgcctacttctataaaggactatctgaactgattgtggatatcgacagattaatttatctatcgctggagaaaatcagaaaagatttcgtgtttatcaatctcaatacggattctttaactgagtttataaaccgtgataatgagtggttatccgcggtaaaggggaaacaggtcgtattgattgcggccagaaagtcagaagccttagcaaattattggtattacaacagcaatattaggggcgtggtatacgctggactgagtcgtgatattagaaaagaactggcctatgtgattaatggcaggttcctgagaaaagatattaagaaagataaaatcactgaccgggaaatggaaattatccgcatgatggctcagggaatgctgcctaaatcgattgccagaattgaaaattgtagtgtgaagacagtgtatacccatcggcggaatgcagaggccaagctgtactcaaaattatataagttggttcagtaaactccaggcaagttagttttaaaaatgactcaccgggacttcatgtcctcaattcaactcgggaagaaggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggactgttgtggcgcacgtcttcggtgaacgcactctggccacactggagcgtcttctgagcctgctgtcggcctttgaggtcgtggtatggatgacggatggctggccgctgtatgaatcacgcctgaagggaaagttgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattacccgggaagaaaagcaatgaaaaaaaaggttctggcaatagctctggtaacggtgtttaccggtacaggtgtagcgcaggctgctgacgtaacagctcaggctgtagcgacctggtcagcaacagccaaaaaagacaccaccagtaagctggttgtgacgccactcggtagcctggcgttccagtatgccgaaggcattaaaggttttaactcacagaaaggtctatttgacgtggctatcgagggtgactcaacggctaccgcctttaaactgacctcacgtcttatcaccaacaccttaacccagttggatacctcaggatccacactgaatgtgggcgtggattataacggcgcggcagtcgaaaaaactggcgataccgtgatgatcgataccgccaacggcgtactgggcggcaaccttagcccactggctaacggttacaatgccagcaatcgtaccaccgcacaggatggtttcactttctccatcatcagcggcaccaccaatggtaccaccgcagtaaccgattacagcactctaccggaaggcatctggagcggcgacgttagcgtacagttcgacgctacctggaccagttaatctctctgatgtaccagcaggggtacccccctgctttattcctggacggaattgttatgaaaaagcaccttctgcctctcgctctgctgttttccggaatatcaccggcccaggcgctggatgtcggcgatatatcatcgtttatgaacagtgacagcagcacgctaagcaaaacgatccaaaacagtaccgacagtggccgcctcatcaatatccgtctcgaacggctctcttcaccgcttgacgacgggcaggttatcgcaatggacaagccggatgagttgctactcactcccgccagcttgctgctacccgcccaagccagcgaagtgatccgcttcttctataagggaccagcagatgaaaaagagcgctactaccgcattgtctggtttgatcaggccctcagtgatgcgcagcgcgataatgccaaccgcagcgctgtggccacggcttccgcccgcatcggcaccattctggtcgtcgcaccccgccaggcaaactaccactttcagtacgccaacggctccctgacaaatacaggaaatgcgacgctgcggatcctcgcctacggcccctgcctgaaagccgccaatggtaaggagtgtaaagagaattactacctgatgccgggcaagtcgcgtcgttttacccgcgtggacacggcggataacaaaggacgggttgcactttggcagggtgataagttcattcccgtgaaatagatagctgtgcagatggataacgacaatgcctttacgacggttctccccaggactgaaagcccagtttgccttcggcatggtctttttgttcgttcagcccgatgccagcgctgctgacataagtgcgcagcaaataggtggggtgattattccgcaggccttcagtcaggcgctccaggacggcatgagcgtcccgctttatattcatctcgccggtagccagggtcgccaggacgatcagcgaatcggcagcgcttttatctggttggatgatggacagttacgcatccgaaaaatacagctggaagagagtgaagataacgccagtgtcagcgaacaaactcgacagcagctgatgactctggccaacgccccgttcaatgaggcccttaccatccccctgactgacaacgcgcagttggatctcagcttgcgccaactgctgctgcagctggtggtcaagcgcgaagcgctgggcaccgtactacgctcacgtagcgaagacatcgggcagtccagtgttaacaccctcagcagtaatctgagctataacttcggcgtctataacaaccagttgcgtaacggcgggagcaacacctccagctatctgtcgctgaataacgttactgcgctgcgcgaacatcacgtggtgctcgacggctcactgtacgggattggtagcggtcaacaggacagtgaattatataaagcgatgtatgaacgcgattttgctggtcaccgatttgccggtggaatgctcgacacctggaacttgcagtccttagggccgatgaccgccatttcagcagggaagatttacggcctttcctggggaaaccaggccagctccaccatcttcgacagcagccagtcggccacgccagtgatcgcctttttaccggcggcgggcgaagtacatctcacccgtgatgggcggctactaagcgttcagaacttcaccatgggcaatcatgaagtggatacccggggtctaccgtacggtatttacgatgtggaagttgaggtaatcgttaacggtcgcgtgatcagcaaacgcacccagcgggtcaataagctgtttagccgggggcgtggcgtcggtgcaccgctggcgtggcagatatggggcggtagctttcatatggatcgctggtcggaaaacgggaaaaagacgcgaccagccaaagagagttggctggcaggtgcctcgacctccggctcactgagtacgcttagctgggcggcaacgggatatggatacgataatcaggcggtgggtgaaacccgtctgacgctgccgcttgggggggcgatcaacgttaacctgcaaaacatgctggccagtgacagctcatggagcaacatcgccagcatcagcgccactctacctggaggcttcagttcgctgtgggttaaccaggaaaaaacccgcattggcaatcaattgcgacgtagcgatgccgacaaccgtgcaatcggcggcacactcaacctgaactcactgtggtcgaagctgggtacgttcagcatcagctacaatgatgaccgccgctacaacagccattattacacggcagattactatcaaagtgtctacagcggtacctttggttcgcttggcctgcgggccggtattcagcgctataacaacggcgacagcagcgccaatacagggaaatatatcgctctcgatctttcgctaccactgggcaactggtttagcgcagggatgacccatcaaaacggctacaccatggcaaacctgtcagcacgcaaacagtttgatgaaggaatcattcgcactgttggtgccaatctgtcacgagccatctccggcgataccggtgatgacaaaaccctcagcggtggggcgtatgcacagttcgacgctcgttacgccagcggaacgctgaacgtcaatagcgcggcggacggctacatcaataccaatttgaccgccaacggcagcgtcggctggcagggtaaaaacatcgctgccagcgggcggaccgatggcaacgctggggtgatattcgacactggcctagagaacgatggtcagatcagcgccaaaatcaacgggcggattttcccgcttaacggcaagcgtaactatctcccgctctctccctatggaagatatgaggtggagttgcagaacagcaaaaactcactcgacagttacgatatcgtcagcggtcgcaaaagtcatctgactctctatccaggcaatgtcgctgtcattgagccagaggtgaagcagatggttaccgtctccggtcgtatccatgcggaagacggcacactgctggctaacgcacggattaacaaccatatcggccgaacccgaaccgatgaaaacggcgagtttgtcatggacgtggataagaaataccccactatcgattttcgctacagtggcaataaaacctgcgaagtggcactggaactcaaccaggcgcgcggtgccgtctgggtcggtgatgtggtctgcagcggcctctcatcgtgggcggcggtgacgcagacaggagaagagaatgagagttaacctactgatagcgatgataatctttgcgctaatctggcctgcaaccgcgctcagagcggcagtgagcaaaacaacctgggcggatgctccggcacgcgagtttgtgtttgtcgaaaacaactcagacgacaactttttcgtcactcctggcggggcgctggatccgcgcctgaccggtgccaaccgctggaccggtttaaaatacaatggttcaggaaccatctatcagcaaagcctcggctacattgataacggttacaacaccggcctttataccaactggaagtttgatatgtggctggaaaattcaccagtttcatctcctttaactggcttgcgctgcatcaactggtacgcagggtgtaatatgaccaccagtcttatcctgccgcaaaccaccgacgccagtggattttatggcgcgacggtgaccagcggcggcgcgaaatggatgcacggcatgttgtcagacgcgttttaccagtatctgcaacaaatgcccgtcggcagcagctttacaatgaccatcaatgcctgccagacctctgtgaactatgacgccagcagcggcgcacgctgtaaggatcaggcctccggcaactggtatgttcgcaacgtcacccatacgaaagcagcaaatctgcggttgataaatacccactcgctggcggaagtatttatcaacagcgacggagtaccgactctgggcgaagggaacgccgactgccggacgcaaaccatcggcagccgttcaggattaagttgtaagatggttaactataccctgcaaacaaacggactcagcaacacctcaatccatatattcccggcgatcgccaactcgtcgttagcctcggccgtcggggcgtacgatatgcagttcagtctgaatggcagttcatggaaaccggtgagcaatactgcctattactacaccttcaacgagatgaagagcgcagactcgatctatgttttcttctcgagcaacttctttaaacagatggtgaacctcgggatcagcgatatcaacaccaaagatctattcaactttcgctttcagaacagtcagtgttgaatgctatccgcacgggttatcgactcatcgacactgcagcggtatacggtaatgaagatgccgtcggtgaagccgttcgtgaagccatatctgaaggtttatgtacccgagaagagttatttataacgtctaaattgtgggtgcaggatatgttgaatcaggatattgcagcagcaggtattgaagcatcattaaaaaaatcggggctagaatacttcgatctctatttattgcaccaggccatgcgcgattattttagtgcgtggcgtgcactcgaagatgcctatgaagagggcaaattaaaagcgattggggtttccaatttctaccctcatgttctggcgaacttttgtgaaacggtaagagttaaaccgatggtcaaccaggtcgagttgcatccctattttgcccaaccagaggcgctggcaaccatgaagtattataacgtgcagcctgaagcatgggctccgttaggtggtggacgacataaaccctttgaaaataatctgcttcagagtattgcagatgcccatcaaaaatcgatttctcaggtcattctgcgttggaatattcaacggggagtggtcgttattccgaaatcgacacatcaacagcgtatcgaagaaaattttgctatttgggatttctcactgacagagaaagaaatggctcaaattagttcgcttgatttgggttatgttggggaatcggtaaaacattttaatcctgagtttgttcgtggttgtcttgctgtaaaaatacatgattgatattaatcacttattttacctgagacgacaagaatcttttaataggggagtgatattgaccttcactctgtcatatctccggtaatatggcgtcaggcttcatcatcagaaagggagcctgacgcctgaaaaagtgaacaacagacagtgttcggattatcaatattcagtttttaacgttgaactggattcattactgcgttgtttaagaatatcccgcgccgaatctgccattatcatgacagcacctgccagcatcagagtatctttcaataccagacgaccagcaccggataaataagggaaaccatgatgagcgtcacccaatgcgggtacccatgcctccggggtggtgattaaaaatgagagtgttaccagcggcgtggtaaatgccatcagcccacccaataaacctaaccagcgattgacaggattagccaaaaccagcagagcaataatcacctccacgacgccaagaccgttggaaaaaccataggtattattagccgtttgccatgctcttgcttctggtttgtattcgccttcgtgagtcagatgctgtttatagtcttccgggtgttcataaaagaacgacattagtggactgtttgcgacgaatggtgtaatgctgtctgcctcgtaagggacaaactttaataacccaatccacataaaaacaatcgcaatactcagacgaatcaatgtcaggccaattttatctccccgacttaacaggtgcaggtatctttccattgtaaacatccttatttatacaatactgctgttgcggttgaattattatcaattcgcatcgatgtaactttccaggatgaagcattatattttctggccatatcagcaatggcattctcaagaactgtcggtgatgctgatactgatgagacgctgatatgtttcagaattattttatcatctgcattggtggaaaatgccataacgccagataatagtgttgcaaataaaacagattttttaaacatataaaataccatcaatgaagtgattaagaagttataaagtaacagggaattaataagattcttttctctgagacgccagaatatttgttctggcgtctgattttgagtttatttgactaatgaaaatagatcattgagtgattcgctcatcgacggatgagtaaatatctgatcgcgtaatatgctataaggcagcccggcatccatcaccattttcactatattgatcatctcgtgggagtcaacacacagcagtgatgcccctaatatacgttgggttttattatcaacaatcgcttttaataccccacgagtatcattcatcactctggcacgcggaattgcagctacaggcaatgtcaccacctgaatatcagcaccactctctctggcctgttcttctgtcataccaaccctggacagtggcggtgtcatgaatacggaataaggcacatttttccgatcatcagtactacgtctgccttctcccagcaactcatcacgcacaatgcggtaatcatccagtgaaatataagtaaattgcagcccgccggtaacatctcccatcgcccaaatattgtctgcggtggtatgtaattgcttgtcaacgacaattgccccgcgctcgtttactgcgatacctgcattttctggatgtaacgaagcggtagccggttgacgaccggaagctattaacagtgcatccaccgccagttgggcgtgctcgctatgcacttgcacttgattttcatggtgactgattcgctccacatgggcattgaggattatatcgacaccctgatcgcgtaaaatcgtcgcgatattatcagcaatatcccgatcttcccgaggcaaaaacagcgaagctgcctctaaaatggttactttgctgccaaaattagcgaacatagaggcgaactcaacgccaatatatccgccgcccaaaatacctaaatgcccaggcaattcttttagattaagtaatccggtgctgtcatatacaccaggcgtggtggtaattccaggaattggcggaaccacggcttgtgcaccggtattaataaaaattttctcgccatgaatctccagatttctcccaggccgatgaacacgcaggctatgattattgataaactccgcctggccgtcgatcacgtcgatattgggcatatccgcaagattatgaaaattcttattacgtaaaaaattaaccacttcatttttacgctgtatggcgcggacaaaatctgtgtgctgctgtgcgtcatgaaccaatgttttggttgggatacagccgatattaatacaggtcccgccatacattgcatttgattgttcgatgagagccacacgccaacctgcttttgccagcgtgacggctaatgtttttccagccttgccaaaaccaataataactgcctgatatttattcatgatgatttcctgtcgaaacgcgttcatttgacatcatgactatagacgcaaaagagcaaataacatttcttcacaacgcttgatattttgtcttatcgtctggtattttctttttcttaatcagaatcacaaaacaaaaatcatgattaactatttgatggtattagattaattattgactaagattgttggtgtttgtaatcaaaaaaccactcaggagtctgatatggatgctcttagccgtttgttgatgcttaacgctccacaaggaacgatcgataagaattgcgtgttaggaagtgactggcaacttccacatggtgccggggaattgtcggttattcgttggcatgcgttaacgcaaggagcggcgaagctggaaatgccgacgggagagatttttacattacgcccgggaaatgtggtcctgctaccacaaaattcagctcatcgcctgagtcatgtcgataatgaatcgacctgtattgtctgtggcactcttcggctgcaacattcggcgcgttattttttaacgtctttgccggaaacgctgtttgtagcaccagtgaaccatagcgtggaatataactggctgagggaggcgatcccgtttttacaacaggaatccagatcggcaatgccgggagtggatgctctgtgtagccagatctgcgctacattctttaccctcgcggtgcgtgagtggattgcacaggttaatacagagaaaaacattctcagtttgcttctgcatccacgtcttggtgcggtaatacagcaaatgatggaaatgcctggacacgcctggaccgtcgaatcgctggccagcatcgcccacatgtcccgggcaagttttgcccagcttttccgtgatgtttccggaaccacgccgctggctgtattaacaaagttgcgtctacaaatagcggcccagatgttttcccgggaaatgctccctgttgtggtgatcgctgagtcagtaggctatgccagcgaatcatcttttcacaaggcgtttgtccgcgagtttggttgtactccgggagaatatcgggaaagggtcagacagcttgcaccctgaataaaaccgccagaaatcagggcaaagataatccgcattccgggagttgtgagcctttcaactatttctatttccaacggtagttttgggctttatatattttttttgatggactctagctcagtttttaaataaaaatgcaaactaaattgcttcaattaaataaaatcccgactattacttgatacgtgattattgtcggtgatttttttgtgcaccatcagtgtatatctcaataacccctgaataagtagctctgaataggtataaggggtgtagcctttttaaatggatttcttatgccaaaaatgatcgtcgatttccccataaaatgtgagcgatgccgaaagaaataaaattagttattgcatttgaagtttagatgaaagattatcatttgtcatacaaatgaggggtggtatgttgctagccaattaaaaaagaacgccatatttattgatgattgatcccccggaaggggggaaccatcgggcataaatgggcatgaagtaatggagtattagttgtgaatgtcaatttctttgtcacctgcattggtgacgccctgaaatcaagaatggcacgagactccgtgctgctactggaaaaactcggctgtcgcgtaaatttcccggagaaacaaggatgctgcggtcagcctgcgatcaatagtggttatatcaaagaagcgattccagggatgaaaaatctgatcgccgcactggaggataacgacgatcccattatttcaccggctggctcttgcacctatgccgtaaaaagttacccgacgtatctggcggatgaacctgaatgggcatcacgtgccgaaaaggttgccgcgcgtatgcaggatctcacctcttttattgttaatacattaggggtagtcgatgtaggtgccagtttgcaagggagagcggtgtatcacccatcttgtagcctggcccgtaagctgggggtgaaggacgaaccacttacgctgctgaaaaatgtgcgtggactggagctgttgacctttgctgaacaggatacctgctgcggatttggcggcacgttctcggtcaaaatggccgaaatatccggcgagatggtgaaagaaaaggttgcgcacctgatggaagtccgccctgagtatttaattggtgctgacgtgagttgcctgctgaacatcagtggacgattacaacgggaagggcagaaagtcaaagtgatgcatattgctgaagtgctgatgagccgctgaggatataaagatgtcgatcaaaaccagtaatacagattttaagacacgcattcgtcagcaaattgaagatccgatcatgcgcaaagcggtggcaaacgcgcagcagcgtattggggcaaatcggcaaaaaatggtcgatgaattggggcactgggaggagtggcgcgatcgggccgcccagatacgtgatcatgttctgagtaatctcgacgcttatctgtaccagctctcagaaaaagtgacgcaaaacggaggtcacgtctattttgcaaaaaccaaagaagacgccacccgctacattttacaggttgcccaacgcaaaaatgcccggaaggtggtgaaatctaaatcgatggtgaccgaagagattggtgtcaatcatgtgttgcaggatgccgggattcaggtgattgaaaccgatctgggtgaatacattctccagctggatcaagatccgccctctcatgttgtggtcccggcaattcataaagatcgccatcagatccgtcgagtgctacacgaacatctgggctatgaggggccggaaacgcctgaagcgatgaccttattcattcggcaaaaaatccgcgaagatttcctcagtgctgaaataggtattaccggctgtaatttcgcggtggcagagaccggttcggtatgcctggtgaccaatgaaggtaatgcgcgaatgtgtaccacgctgcctaaaacgcatattgcagtgatgggaatggagcgtattgctcccacgtttgcagaggtagatgtattgatcaccatgctggcgcgcagtgccgttggtgcacgtttgacgggatacaacacctggctgacaggaccgcgcgaagcggggcacgttgatggtcctgaagagtttcatctggttattgtcgataacgggcgttctgaggtgctggcctctgaatttcgggatgtgctgcgctgtattcgttgcggggcttgtatgaatacttgtccggcatatcgccatattggcggtcatggatatggctctatttatccagggccaattggtgcggtgatttccccgttacttggcggctataaagattttaaagatttaccctacgcctgctctttatgcaccgcttgtgacagcgtgtgtccggtgcgtattccgctgtcaaaactgattttgcgtcatcgtcgggtgatggctgaaaaagggatcaccgcaaaagcagagcaacgggcgataaaaatgttcgcttatgccaatagtcatccaggattgtggaaagttgggatgatggctggtgctcatgcggcaagctggtttatcaatggcggcaaaacaccactcaaatttggcgcgattagcgactggatggaagcacgcgatcttcctgaagctgacggagagagtttccgtagttggtttaagaaacatcaggcgcaggagaaaaagaatggataatcggagcaaatttttgaataacgttgctcaggcactggggcgcccgctgcgacttgaaccgcaagcagaagatgcgccgcttaacaactatgctaacgagcggcttacccaacttacccaacagcagcgctgtgacgcgtttatccagtttgccagcgatgttatgttgacgcgctgtgaactgaccagcgaggcgaaggcggcagaagctgcaatacgtctgtgtaaagagctgggagatcagtcggtcgtgattagtggtgacacgaggctggaggaattggggattagcgaacgtttgcagcaggaatgcaatgccgttgtttgggatccggcgaaaggtattgagaacatatcacaagcagagcaggctaaagtgggcgtcgtatatgctgaatatggtttaaccgaatcgggaggcgtggttcttttttccgccgccgggcgcgggcgttcattgagcctgctcccggaatcttctctttttatcctgcgtaaaagcacaatcctgccgcgtgtagcgcaactcgcagaaaaattgcatcagaaagcgcaggccggtgaacgaatgccgtcatgtattaacatcatcagtggtcccagttcaacggcggacattgagcttatcaaagtcgtcggggttcatggtccggtgaaagcggtgtatctgattattgaggattgctgagagagatatgtagtctggacataaacctgaaggcggtatacgaggttgtgaatagcgttaaggacaacctgacttaaccccgttccgtcatggttatgcagctcttctgtaaatatcctgacattaataatgccaggatatttacagttaaaaagacaggaatccattcctgaagacgggctcccttcccggtcactgtcactatagttttatacaggcactctctgtcagaatgctgtttattactgcccagagttttgttggtattcatctaccatttttttgacaaggcaaaacatcacagaaatcacaatacttagaaaaaatcccagagccaggcaaatggcagcagggtatttattttttatttctggtgagcttatagtgacacagccatcaccgttcggatacagtgaccagttcctggtcaggtatatcatttttgtataaagctcactgttaattgctgaaggcgtttgtatctcatcgagaacttgcctgccattatggtattctgacgcataccatttgatgatagacgcctgcacgcgagatatttccgcttcagcagttggtaaatctctcttatttcctgaccattccagctttatttctctgttcttgacatctgggctggtctgaaaaaatgtagtaattcgctgaataacatcttcagtcattgtggtctgacaggcaaagttattattgctatcacagctaacaagtatgcctggtgttgtctggtttatttttagactgtaagtcacttttatattatctttattgatatacagaaacaacagcaccattaccatacagatagctataataaaaaggataacacgaatctttttcttcagataaaataaaatctcaatcagatcgatatcctgtttgatttgttcattcataatatatccagaaaatgaaatctgtcgcagataagattgtattaatagtctgtatcaggaatgttcagggtaaatatcagcaaaaagccagcatcatgaatactggatatttatagcctgcaggcagcatactgctgcctgcagggggtataacagtcgacaggggaaccgactgctttattcttaccaggtcacattgataccaactacaccctgtagcgggttctcaatgtcgtcacctttggtgtagtcaaggcttgcatatgctcccatgtttttggtgatatcagcctgtacacctgcacccacgcggaatgctgcaccgtcaatgctggcattgacagactcatcacccagacggactttgttgccatcagagaattcgttcagtgcggccagattcagataaggtttaacggtcgcgttgcccacagcgaagtcataacccacgcgcgtaccggcctcacccagcacagagttatagctgtcagaatgaacgtccacgccgttgagttgataatccacaccttccagagtcagagcagacagtttggcatatggctgaataaacaggccattaccgtctttccatgtgtaaccgcctttaaccatcgcaccaaaaccattggtgttaaagtcagctttgatggtaccgccaccattcatcaggcgaacatctgccgtgttgctgtagtgactaaactgtgcagcagtatcaatgaagataccgttgttatactggcggctcaggtaagcgtggaagctgtaaccttcagtgtcacctttgctctgcatggtagtcatgtcacctttcgcagaagacatcgccacaccggccagccagctaccatcttcagtcatgaagcgggtatcaccacccagcattacaccatttacatccaggtcataggatgcatttcccgcggtggtatgtttctgtttaccgccaaagtactgaatccatacgccacccttgtcattttcgctcagacggacagcatcctgacgggcggagagcgtgtcagcctgcagattagcgacgttagccggagcagctgccattgcctgaatcacggagctggcgttggatgctttatgcgtgttttttacgaaataaaagttaccatcagctccctgtgtcaggtcatattgatacagaccaccttccgttgtgcctgtggcttttagagtgctgtctttgccggtagaaataaatgccgtttgttcattgataagatccaatgaacccgcactgtaaacacgcaagtcaccgctcgctttaccgctgatatccagagtgttttcagaagaggcatcaacaatcagagtgccgttttgagaagcaaacgtgccagtattgactgtagccttcgtgatattaaccgtactgtcttttactgccagagcatcaacagttgaggaacccgtaacattccagacagacccgttttgcagagatacactggcatctcctgcccctgaaactttgcctttccagactgaactatcggaaagatttatatccagatcactacccgctttatcgccgctattgaaggtataagcattaccttcccagtaagagcgggcaacgttcatatttacatttgttgtggtactggctgaattctcgctttcagaaagggccaggacatcagagtagatggttgaatcagcaacagacaaatttaaattttgcgttgctgaacctgcgccttgtgccgaagcagaggcataaattgtttgtttattattagccgccccaattactgagccatccttaatattcaggttgactgtatgaattcccgtcttattcccggcagtaactattgtttcaatcccgccattaataatatttgagtcagcaagggtgatgttgtcggttgcatcaccgtcaaaaccctgcaacaaattacccttttgagcaaaaattgccgtagagccgttgctgtaactcttattaccttgagcatttatggttgtaccattgagcgttaaattatttcccgtggtcgcttccagagatatccctgtcgcactacctttttcattttttgcaacgaaattaccgccattaacaacaacatcgccagttgaatcaatgaccattgcagtccggacataggtgccttcaccttgagctgtgatggtggagtctgtagcattaatcacaacatttttgttaccactaacttttacaccttcaacgaaatcttggtttaccgttgatgcggcggtaatatcgtgaccgccaaaagtaacattaaggtctttatctgaatctgacgtttcaattgttacggctgtaatcttgttatcaccgttaataacaacatcttgatccagagtcgtcttctctgtattcagcgtaaccggatcagttgctggcggagattgaagaactgttcaacaccaaagcgcaaagcggctcgcacgaggcgcgttacgccactattgccagcgccaaaaagtatatcccggaaagtaacctggcagtgatttcggtcaacggtctgtttgccgctcgcgaagcgcgtcaggcgctgcaaaatgacctcaacgtgatgctgttttccgataatgtctcagttgaagatgaactggcgctcaaacagttggcccatgaaaaagggctgctgatgatggggccagactgcggcacggcgattatcaacggcgcggcgctctgctttggtaacgccgtgcgtcgcggcaacatcggtattgttggcgcatctggcaccggcagccaggaattgagcgtccgtatccatgaatttggtggcggcgtttcacaactgatcggcaccggcgggcgcgacctgagcgagaaaatcggtggcctgatgatgctcgatgccatcgggatgctggaaaacgatccgcaaactgaaatcattgtgcttatctccaaaccgcctgcgcctgcggtggctcgcaaagtgctggaacgcgcacgcgcctgccgcaagccagtggtggcctgcttcctcggtcgtggcgaaacgtcagtggatgagcaggggctacagtttgctcgcggcagcaaagaggcggcattgaaagcggtgatgctctccggcgtgaaacaagaacatctcgacctgcatacgcttaaccagccgttgattgcggatgtgcgggcgcgtctgcaaccgcagcagaaatacattcgtggtctgttctgcggcggtacgctgtgtgacgaaaccctgttcgcggtgatggaaaaacatggcgatgtctacagcaatatccagcccgatcctgaattccgcctgcaagatatcaaccgcagcatcaaacacaccttcctcgattttggcgatgatgacttcaccaacggcaagccgcatccaatgattgacccgaccaaccgtatcagccgcttgatcgaagaagcgcgcgatccagaagtggcggtgatcgtgatggattttgtgctcggatttggatcgcatgaagatccggtcggttccaccatcgaggcgatcaaagaagcgaaagcgatcgccgctgccgaaggacgcgagttgatcattctcgcctatgtgctgggcaccgatctcgatacgccatcattagaacaacaaagccagatgctgcttgatgccggagtgattctggcgagcagcagcaccaataccggattgctggcgcgtgaatttatctgcaaaggggaggaagcctgatgagccagtcactgtttagccaaccgttgaacgttattaacgtcggtatcgccatgtttagcgatgatctgaaaaagcagcatgtagaagtgacccaactcgactggacgccgccggggcagggcaatatgcaggtggtgcaggcactggacaacattgccgattcgccgctggcggacaaaatcaccgccgctaaccagcaggcgctggagcgcattatccagtcgcatccggtgctgattggttttgatcaggcgattaacgtggtgccgggcatgacgccgaaaaccattcttcacgccgggccgccggtcacctgggaaaaaatgtgcggcgcgatgaaaggcgcggtcaccggagcgctggtgtttgaaggactggcgaaagatctcgacgaggcggctgagctggcggcttccggggagatcaccttctcgccgtgccacgagcacgactgtgtgggatcgatggcgggcgtcacctcggcctcgatgtttatgcacatcgtgaaaaacaaaacctatggcaacgtcgcttataccaacatgagcgagcagatggcgaagattttgcgtatgggcgctaacgaccagagcgtgatcgaccgcctcaactggatgcgcgatgtgcagggacccatgctgcgcgacgcgatgaaaattatcggcgaaatcgatctgcgcttaatgctggcgcaggcgctgcatatgggcgatgaatgccataaccgcaataacgccgggacgacgctgctgattcaggcgctgacgccggggattattcaggcaggttattccgtcgagcaacagcgcgaagtgtttgagtttgtcgccagcagcgactacttctccggcccgacgtggatggcgatgtgtaaagcggcgatggatgcggcgcacggcatcgaatacagcaccgtggtgaccaccatggcgcgtaacggcgtcgagttcggcctgcgggtcagcggcctgccggggcagtggtttaccggcccggcgcagcaggtcatcggcccgatgtttgccggttataagccggaagattcagggctggatattggcgacagcgccatcaccgaaacctacggtatcggcggatttgcgatggcgaccgcgcccgcgatcgtcgcgctggtgggtggcacggtggaagaggctatcgatttctcccgtcagatgcgtgaaatcacccttggcgaaaaccccaacgtcaccattccgctgctcggttttatgggcgttccgtcggcaatcgacatcacccgcgtgggtagcagcggcattctgccagtgatcaacaccgccatcgcccataaagatgcgggcgtcggcatgattggcgcgggcattgtgcatccacccttcgcctgcttcgagaaagccatttttggctggtgcgaacgttacggcgtctgatctgtaaagtgcgcgttgtttctgccggatgcggcgtgaacgccttatccggcctacgaatggcgcggaaatctgtaggcctgataagcgtggcgcttcaggcattggccaccacagccggatgcggcgtgaacgccttatccggcctacgagtggcgcaagaatctgtaggcctgataagcgtagcgcatcaggcagtctggcgttggtcataaccccatcaccctctgtcgcggacataacaacatgaaagaacttgtggtcgttgccattggtggcaacagcattatcaaagataacgccagccagtcgattgagcatcaggcggaggcggtgaaagccgtggccgatacggtgctggaaatgctggcttccgattacgacattgtgctgacccacggcaacgggccgcaggtcgggctggatttacgccgcgcggagattgcccacgagcgcgaagggctgcccttaacgccgctggcgaactgtgtggcggatacgcaaggtggcattggctatctgatccagcaggcgctgaacaaccgactggcgcgtcacggcgagaaaaaagccgtcaccgtggtgactcaggtggaagtggataaaaacgatccggggtttgcccatcccaccaagcccatcggcgaattctttagtgaaagccagcgtgacgaactacaaaaggcaaaccctgactggcgttttgttgaagatgccggacggggctatcgccgcgtggtcgcctcgccggaaccgaaacgtattgtcgaagcacctgccattaaggcgctgatccaacaaggctttgtggtgattggcgcgggcggcggcggaattccggtagtgcgtactgacgcgggggattaccaaagcgtggacgcggttatcgacaaagatttctctaccgcgctactggctcgcgaaattcacgccgacattctggtgatcaccactggcgtcgaaaaagtgtgtattcactttggcaaaccgcagcagcaggcgctggatcgcgtagatattgccaccatgacccgctatatgcaggaagggcatttcccacctggcagcatgttgccaaaaatcatcgccagcctgacgttcctggaacaaggcggcaaagaagtgattatcaccacgccggaatgcctgcctgcggcgctacgcggcgaaacgggcacccatattattaaaacctaaggacgtaagatgaaagaaaacaatagccgccgtgaatttctgagccagagcggtaagatggttaccgccgccgcgctgtttggtccctcagtgccgctcgcccatgcgggggtagctggcaccctaaactgcgaagcgaacaacaccatgaaaatcactgacccgcattactatctcgataacgtgctgctggaaaccggttttgactacgaaaatggcgtggcggtacagacccgcacggcgcgccagaccgtggagattcaggacggtaaaattgttgccctgcgcgagaacaagcagcatccggacgccacgctgccgcactatgacgctggcggtaagctgatgctgcccaccacccgcgacatgcatattcatctcgataaaaccttctacggcgggccgtggcgctcgctcaatcgtccggcaggcaccactatccaggacatgatcaaactcgagcagaaaatgctgccggaactgcaaccgtacacgcaggaacgggcggaaaaactgatcgatttattgcagtcgaaaggcaccaccattgcccgcagccactgcaatatcgaaccggtttccggcctgaaaaatctgcaaaatttgcaggcggtgctggcgcgacgtcaggcgggcttcgagtgtgaaatcgtcgccttcccgcagcacggtttgctgctgtcgaaatcggaatccttaatgcgcgaagcgatgcaggcgggggcgcattacgtcggcgggctggacccgaccagtgttgatggcgcgatggaaaaatccctcgacaccatgttccagattgcgctggactatgacaaaggcgtcgatattcacctgcacgaaaccacgccggcaggcgtggcagccatcaattatatggttgaaacggtggagaaaacgccgcaactgaagggcaagctgaccatcagccacggctttgcgctggcaacgctcaacgaacaacaggtagataaactggcgcaccggatggtggcgcagcaaatttctatcgcctcgacggtgccgattggcacgttgcatatgccgctcaaacagctgcacgacaaaggcgtaaaagtcatgaccggcaccgacagcgttatcgaccactggtcaccctacggcctgggcgacatgctggaaaaagccaatctgtacgcgcagctctatattcgtcctaacgaacagaacctctcccgctcgctgtttttagccactggcgatgtattgccgctcaacgaaaaaggcgagcgcgtgtggcccaaagcgcaggatgatgccagctttgtgctggtggacgcctcctgttccgccgaggcggtggcgcgtatctcgccgagaaccgcaacgttccataaagggcaactggtgtgggggagtgtggcaggttgatgcgcatttgaaacgtctgcaacggtgaacagtaagagatttaagccccagggagtggggcgggaatggtttgttaatgaatgatcctgaactttataatctcccggcataatttccaggggattatttgagagaaatacacaaaagtgagttttaacaaaggtatttatcaagccataaatgtgacctgcttcggataaaaaagattaaacataggaaaaccaatgatcctcttgctgatggttatcaacagtaattaagatgtgatttttttccgtaatcgcgaaaatattctcatgaccataaaagaaaaaatctcacaaaaatatccccatgcttccttttgtacttttggcgattcagcagcgttggccgatcacctcgcaacgatgattgcgactggtgttaaaactgcttcctgtggttcgctggcgggatgtattgaagacaacgcatttccgctgattggtgagtataagattgtagaaaatagccgtggtgagcctgtctgtgttatcagagtgattggcctgcatttactgcgcttttctgatgtcaccgcagagcttgcccgtaaggaaggtgaaggtgacctcagtcttgaatattggcgtaatgaacaccgtcgttttttccaggcagaaggatgctattcaccagaaatggacgttatctttgaagaatatgcccttattgacgttgtgtagataactatttttctacgcgaaataagctctcaaacataaagtatcgctaattttgtttattttgctattttttacgtgatgattgtcacacttattgttattgcccgttttgtccatatttataaccaaatttttaatagctgcctgaaatagggctgtttattctgcataaaaatattcgaaaattcttattctctccagcgcgctaatttgggcgaacacttcctgactaccctgcaatgaggctgaaatgatgaataaacgttttgttatcaatatggtgtcttcgctgttattaggcgctgcgctaatttctgcgccgctccaggcagcggaaaaagtggtggtgaatatctctaaagtcgatggtatgccgtggtttaatcgcatgggcgaaggtgtggttgaggcgggtaaagcctttggtgttaatgcgtcacaggtggggccttcaagtactgatgctccgcaacaagttaaaattattgaggatttaatcgcccgtaaggttaatgcaattacaattgtgccaaacgatgccaacgtgctggaaccggtattcaaaaaagcgcgagatgctggaattgtggttctgaccaacgaatcccccggtcagccaagtgctaactgggatatcgaaatcattgataacgaaaaatttgccgctgaatatgttgaacatatggcgaaacgcatgggtggcaagggcggctatgtgatttacgtgggtagtttgaccgtgccgcagcataacttatgggctgacttgctggtgaaataccagaaagagcattacccggatatgcatgaagttacccgccgcatgccggttgccgagagtgtggatgactcacgtcgtaccacactggacctgatgaaaacctatcctgacttgaaagcggttgtctcctttggttcaaacggtccgattggcgcgggacgtgcagtgaaagagaaacgggcgaaaaataaagtcgcagtctatggcatgatgagcccttcacaggcggcatcactgattaaaagtggtgatatcaccgaagggattacttacgatccggcctctgcaggttacgcactcgcagccgtcgccagcacgttgctgaagggtgaagagatcaaacctggattagaaatggagaatctcggtaaggccgacgtagatatggataagcgaattatccgtttccataaggtattactggtcaacaaagacaatatcgactcactttattaatccatttcttcggggcgaaagccccgattcttattgccaggggatgctatggaaaccttcctttcccttcgtcatatcaacaaaacgtttcatgccacgcgagcgctgcgcgatgtttctctcgactttatgtcgggtgaggtgcactgccttgccgggcaaaacggctgtggtaaatcgacgttgattaaaattatgtccggtgtttatcgcccggatgagggggcggaaattacgcttggtgggaaaaactggtcaaagctgacacccgccgcttcggtggcgcaggggattcaggtgatttatcaggacctctctttatttcctaacctgagtgtctgggagaatatcgccgtgaatcactatcaccacggtctgtttgttaaccgccgtcgtctgcgtgaggtggcgcaggcggcaatgatcagtattaacgtcacattgccattggatacgctcgtttctgagctttcaattgcccgctgtcagctggtggcaatttgccgtgcactggcgcaggacgcacggttgatcgtgatggatgaaccaaccgcttcgctgacccatcaggaagtgcaagggttattacaggtggtgcatcaattgcgggaacgcgggatctgcgtggtcttcgtcagtcatcgtctggaagaggtgatggaagtttccgaccgtatttcagtgttgaaagatggtgagctggtcgggacctttccggctgcagagatgaccacaaaacaactcggtttccttatgaccggccaggagtttgaatatcaggtacgagagttgtggcagggaaaatccagcaccccagtgctggaggtgcgtaatttaagtcgtcatggggaatatcaaaatattaacttgcgggtggaagcgggcgaagtggtgtcgattgttggcctgcttggtgcggggcgcacggaattatgtctgagtctgtttggtatgacccgaccggatgctggtgagatcctcatcaacggtcagccggttacactgcatagtaaccaggacgccatccgccacggtattggttatgtttcggaagatcgcatgtcgcgcggtttggtgatggcgcaatctattgaagacaacatcattagcactgtttttcacaaggtaaaagatcgcttcggctttctgagtgaagctaaagtgcgtgacctggtggacaggctaatcaaggcattgaccatcaaagtctctgacccacatctcccagtgaatacgctttccgggggtaacgcgcagcgagtatcgatcgccaaatggctggcgattgggccacgactgttgattctcgatagcccgactgtcggtgttgatatcgccaacaaagcaggaatatacggcattatcagcgatctggcggctcatggcattgcggtattgatgatctgcgatgaaattgaagaagcgtggtatcaaagccaccggattttggtaatgcaaaaaggtcagatcacccatagcttcctgcctgacagcagttctcaggccaggattgcggaggtggtaaatggctgaactgaaaaaacgtcatgaattctggctggcattactgattatggtgctgtttgttggccttgcctggcgcagcgacgagtttctgacattcggtaatttgtacgatctcgccaataactatgccatgttgactattctcgcctgtggtttgtttgtggtgttgatttccggtggaattgatatttcgtttccggcaatgaccatcattgcgcaatacggcatggtgctgttgctacaaaaaattggtggtaactttgctgtcgcgtttgcactggcgggcggcatcggcattttacttggcttaattaacgccttactggttaatcgcctacgggtgccttctatcatcatcaccatttcgacgctgaatattttttatggcctgctgttatggttgagtaaaggtgtgtggctgtacgactttccgccgtggtttgagcagggggtaatgttgttcaagtacaccgatgctgacggctatgactatggccttggtctgccgctgatcgccatgattacggtggtgctgctgacagcgtttatcatgaatttcaccagtgtagggcgcaaaatttatgcccttggcgggaaccgtgaatccgccagtcgcatcggctttagcgtgctgaaactgcaacttttcgtctacggctatatgggattgatgtctggtgctgcgggtgtagtgcagtcgtggacggtgatgactgtcgcccccgattctcttctgggttatgagctgacagtactggctgcggtggtgcttggtggcactagtttgctcggcgggcgcggcacgttaaccggtactttgctcggcgtggtgttgttggcagtgatgcaaaacgggctaaatttattgggagtctcgtcttactggcaaacattgatcaccggcatcatcatcgttgccagcattagtgccacggcgtggagtcagcatcagaatcggagtctgctatgaaaaaatcgtggcgtaataacgttgagttttacttgatcggcctgctggtgctaactgttgccgcgttcagcattactatgccggagattttctggtcgataagtaatttccagtccgtcgcttcgcaaatgcccgtgctgggcattctggcgttggctatggcggtgaccatgctttgcggtggcattaacttgtcaattattgccactgctaacgcctgttcactggtgatggcgtgggtggcgactcagtatccaccgggtattgctacggttgtcgctacgttactggcgggcgctggcgcggcggtgataatcggtttatgtaacggcgtattgattgctggtattcgagtgtcgccaattcttgcaacgcttgggatgatgacgttgctcaaagggataaatattctggtgacaggcggtagcgccattgccaattatccctcatgggtgctgtggttgaatcatgcacagtggttcggtattccgctaccgatgtggttgtttgccgcagtggcactggggctgtggatattgctggagaaaacgccgctcggtaaatccatttatctgattggttctaacgaacgagcaacactttactccggtattaacactcgtcgggtgctgatatgggtgtatgtcatttccgccttgctttgtgcggtagcggcatttttgatgatgtcgaaactcaactcggctaaggcctcttatggcgaatcgtacttgctggtgtcaatcctcgcggcagtactcggcggggttaatccggacggcggcagcgggcggataattggtatggtgctggcgctgtttcttctgcaaattattgaaagcggcttcaatattctcggtataagcccctacctgacgatggccttatggggaacgttgctgctctgtttcattcaggctcgcggcatgttggggctggatcgggtggtttaaatattggctatattcaatggacgcgttttgccgcgatgacatatcaggcatcgccaaatacacatagctaatcaggagtaaacacaatgaagatcaaagctgttggtgcatattccgctaaacaaccacttgaatcgatggatatcacccggcgtgaaccgggaccgcatgatgtcaaaattgaaatcgcttactgtggcgtctgccattccgatctccaccaggtccgttcagagtgggcggggacggtttacccctgcgtgccgggtcatgaaattgtggggtgtgtggtagccgttggtgatcaggtagaaaaacatgcgccgggcgatctggtcggtgtcggctgcattgtcgacagttgtaaacattgcgaagagtgtgaagacgggctggaaaactactgtgatcacatgaccggcacctataactcgccgacgccggacgaaccgggccatactctgggcggctactcacaacagatcgtcgttcatgagcgatatgttctgcgtattcgtcacccgcaagagcagctggcggcggtggctcctttgttgtgtgcagggatcaccacgtattcgccgctacgtcactggcaggccgggccgggtaaaaaagtgggcgtggtcggcatcggcggtctgggacatatggggattaagctggcccacgcgatgggggcgcatgtggtggcatttaccacttctgaggcaaaacgcgaagcggcaaaagccctgggggccgatgaagttgttaactcacgcaatgccgatgagatggcggctcatctcaagagtttcgatttcattttgaatacagtagctgcgccacataatctcgacgattttaccaccttgctgaagcgtgatggcaccatgacgctggttggtgcgcctgcgacaccgcataaatcaccggaagttttcaacctgatcatgaaacgccgtgcgatagccggttctatgattggcggcattccagaaacgcaggagatgctcgatttttgcgccgaacatggcatcgtggctgatatagagatgattcgggccgatcaaattaatgaagcctatgagcgaatgctgcgtggtgatgtgaaatatcgttttgttatcgataatcgcacactaacagactgaaaaaattaataaacaccctgtggtttaacatattaacttcgctccacttaactttttagttaaggagagcgaaataatatcaaagtagtggtaaacctatagcgtaaattcaaattgttaaattaactccactactttacacgttagttatgagcgatttctgatagtgtctggttttatcagagctttattatctgcgacgtttatttttatttaagagagccacctgcaagttgttattccaccagagagtgaatcgcaaagcaggtcatcatttcatctgtatatctgtatgccaaatggcattccccctcctttttcgccgatattttgttgtgaacggcggagtttcgcttaaaaaagcaccagtagtggtttcgcagctatatggtgtataaaaaatgttctcatacagatgttttgtgaatgtgtgggttgacattcatatgaaaaaaatcataattccatcatgtttgtgtggggtcttttctgtatcttacgcatcgcactcaagcctgacagaaaatatgttgtaaggctcatatcaaaaaccgccattagctcatcaggaagagcagacgacaaccaggattgttgtatggtacggggttcgaggcctcgatggcggtccaacttttcaaaacttttctgaatcagatccccttattatcatccctgcaaagtggaacattgccattgtttggctattcaggacgggtcagaccaatgaaaaagcccacacaggggagagtggctgaaacgggaagctaaagactcaagtaaacttatcggaaataaggaccacgcattacgggggctatcatcgccgatggtcgggatccggcaaatcaggttgattacgtagagagtaaattatctgctcaccgctgcgtcaccccttcgtaaatcaggcgtagcgcgaatacaccaataattgcaccaataacccgactggcaacgcgttgcatacgcccataagcacgacgcactgcgggcaaagaaaacgcctgactaagaaagactcgccagataattgatgcgagcacaatccccgcccaggccattaatcgtgcccatgttggtgtttcggcatgtaatgttactgagaaaatactgataaaaaataaaacggtttgcgggttagagagatcggtaattaatccacggcggaaaaagacataccagggggcgctaatcggttgttgtagtgtgctcatttgcggtgttgacaggcggtgcatgctacaccatgcaaaccataagagataagcgccgccgacgattctgataagcgaaaaaatctcctcacactgcgtaattagcgttgcaagaccaaacaaacccaacccggaataaaatgcatcgcccagcgccacgcccagcccggtcaacacccccgcgcgtcgaccggaagccaggctggtttgtactaccacaaagagattggctcccggattaaaaaaagtaatcacgaacaatcctacggtcaggtaaacggcgtgcaaaggatccatagtgatttcatccataaataagtgaagtaacttcatcatatttctaccaaaaataatcgggtgcgagagagatcacaaagtgtcttatttccggttactggcgtttatgccctgactgaactaattattaatcaacccaataatgtgggtgggtgatagtgtgataacaactctggagccgtaatatgaaaataatctctaaaatgttagtcggtgcgttagcgtttgccgttaccaatgtctatgccgcagaattaatgaccaaagcggaatttgaaaaggttgcatcgcaatatgaaaaaataggtgatatttcaaccagtaatgaaatgtcgaccgcagatgcgaaagaagatttgatcaaaaaagccgatgaaaaaggggctgatgtgttggtactgacctctggtcaaactgacaataagatccacggcacggcaaatatttataagaagaagtgattctgaatcctatgtaaacatccccgatgcgtaagtttatcggtgatcatcatctatcgaaatttatgccggataaagcgttcgcgctgcattcggcagttcagcttttcagccgccgccagaacgtcgtccggctgatacctaaataattcgccgctgctgtcttatcgccattaaatttctccagtgcctgttgtgctgtcagcaagccttgaatgggagtcttcgccgactcgcgcgccagttccggcagtagcagctgcaaaaattgcggcgttaaatccggcgtcggttccacacttaaaaataacgccagtcgttccatcatattgcgcagttcacgaatattgcccggccagtcgtagagcaataatacaatctgacaggtctctaatccctgacgtaatgcggcagaaaaagggacagagagtgccgccagagacattttcaaaaagctttccgccagcggcagaatatccgccacccgctcgcgtagcggcggcagttgtagacgcaaaatactcagccgataaaacaggtcacggcgaaactgcccttgctgcatatcttcttccagattgcagtgagtggcgctaatgacccgcacatccaccggaacaggctgatgcccgccgacgcgggtgacctctttttcttccagcacccgcagcagccgagtctgcaacggcagcggcatttcgcctatctcgtcaagaaacagcgtgccaccgtgggcgatttcaaacagcccggcgcgtcctccgcgtcgcgagccggtaaacgccccttcctcatagccaaacagctccgcttccagcagcgattcggcaatcgctccgcagttaacggcaacaaacggatgtgactttttgccctgtcgcgcatcgtggcgggaaaaatattcccgatgaatcgcctgggccgccagctctttgcccgtccccgtttccccctcaatcaacaccgccgcactggagcgggcatacagcaaaatagtctgccgcacctgttccatctgtggtgattgaccgagcatatcgcccagcacgtaacgagtacgcagggcgttgcgggtggcatcgtgagtgttatgccgtagagacatgcgcgtcatatccagcgcatcgctaaatgcctggcgcacggtggcggtagaatagataaaaattccggtcattccggcttcttctgccagatcggtaatcagccccgcgccgaccaccgcttcggtgccgttggcttttagctcgttaatctgcccgcgtgcgtcttcttcggtaatgtagctacgttggtcgaggcgcaaattaaaggttttttgaaacgctaccagtgccggaatggtttcctgataggtgacaacgccgatagaagaggtgagttttccggcttttgccagcgcctgtaacacatcgtagccactcggttttatcagaatcaccggtaccgacaggcggcttttcaggtacgcaccgttagagccagcggcaatgatggcgtcgcagcgttcgctggccagttttttgcggatgtaggccaccgctttttcaaagccaagctgaataggggtgatgttcgccagatgatcaaactcgaggctgatatcgcgaaacagctcgaacagccgcgttacagataccgtccagataaccggtttgtcgtcattcagccgtggtggatgtgccatagcgcaccgcaaagttaagaaaccgaatattgggtttagtcttgtttcataattgttgcaatgaaacgcggtgaaacattgcctgaaacgttaactgaaacgcatatttgcggattacttcatgactttatttataacaaattgaaattaaacatttaattttattcagtcaattgtggcacaccccttgctttgtgtttatcaacgcaaataacaagttgataacaaaggatgggctatgtctctacactctccaggtaaagcgtttcgcgctgcactgactaaagaaaatccattgcagattgttggcaccattaacgccaaccatgcgctgttggcgcagcgtgccggatatcaggcaatttatctctccggcggtggcgtggcggcagggtcgctggggctgcccgatctcggtatttctactcttgatgacgtgctgacagatattcgccgtatcaccgacgtttgttcgctgccgctgctggtggatgcggatatcggttttggttcttctgcttttaacgtggcgcgcaccgtgaaatcgatgattaaagccggtgcggcaggattgcatattgaagatcaggttggtgcgaaacgctgcggtcatcgtccgaataaagcgatcgtctcgaaagaagagatggtggatcggatccgcgcggcggtggatgcgaaaaccgatcctgattttgtgatcatggcgcgcaccgatgcgctggcggtagaggggctggatgcggcaatcgaacgagcgcaggcctatgttgaagcgggtgccgaaatgctgttcccggaggcgattaccgaactcaccatgtatcgccagtttgccgatgcggtgcaggtgccgatcctcgccaacattaccgaatttggcgcaacaccgctgtttaccaccgacgaattacgcagcgcccatgtcgcaatggcgctctacccgctttcagcgtttcgcgccatgaaccgcgccgctgaacatgtctacaacatcctgcgtcaggaaggcacacagaaaagcgtcatcgacaccatgcagacccgcaacgagctgtacgaaagcatcaactactaccagtacgaagagaagctcgacgacctgtttgcccgtggtcaggtgaaataaaaacgcccgttggttgtattcgacaaccgatgcctgatgcgccgctgacgcgacttatcaggcctacgaggtgaactgaactgtaggtcggataagacgcatagcgtcgcatccgacaacaatctcgaccctacaaatgataacaatgacgaggacaatatgagcgacacaacgatcctgcaaaacagtacccatgtcattaaaccgaaaaaatcggtggcactttccggcgttccggcgggcaatacggcgctctgcaccgtgggtaaaagcggcaacgacctgcattaccgtggctacgatattcttgatctggcggaacattgtgaatttgaagaagtggcgcacctgctgatccacggcaaactgccaacccgtgacgaactcgccgcctacaaaacgaaactgaaagccctgcgtggtttaccggctaacgtgcgtaccgtgctggaagccttaccggcggcgtcacacccgatggatgttatgcgcaccggcgtttccgcgctcggctgcacgctgccagaaaaagaggggcacactgtttctggtgcgcgggatattgccgacaaactgctggcgtcacttagttcgattcttctctactggtatcactacagccacaacggcgaacgcatccagccggaaactgatgacgactctatcggcggtcacttcctgcatctgctgcacggcgaaaagccgtcgcaaagctgggaaaaggcgatgcatatctcgctggtgctgtacgccgaacacgagtttaacgcttccacctttaccagccgggtgattgcgggcactggctctgatatgtattccgccattattggcgcgattggcgcactgcgcgggccgaaacacggcggggcgaatgaagtgtcgctggagatccagcaacgctacgaaacgccggacgaagccgaagctgatatccgtaagcgggtggaaaacaaagaagtggtcattggttttgggcatccggtttataccatcgccgacccgcgccaccaggtgatcaaacgcgtggcaaagcagctctcgcaggaaggcggctcgctgaagatgtacaacatcgccgatcgcctggaaacagtgatgtgggagagcaaaaagatgttccccaatctcgactggttctccgctgtttcctacaacatgatgggtgttcccaccgagatgttcacaccactgtttgttatcgcccgcgtcactggctgggcggcgcacattatcgaacaacgtcaggacaacaaaattatccgtccttccgccaattatgttggaccggaagaccgccagtttgtcgcgctggataagcgccagtaaacctctacgaataacaataaggaaacgtacccaatgtcagctcaaatcaacaacattcgcccggaatttgatcgtgaaatcgttgatatcgtcgattacgtgatgaactacgaaatcagctccagagtagcctacgacaccgcacattactgcctgctcgacacgctcggctgcggtctggaagctctcgaatatccggcctgtaaaaaactgctggggccaattgtccccggcaccgtcgtacccaacggcgtgcgcgttcccggaactcagtttcagctcgaccccgtccaggcggcatttaacattggcgcgatgatccgttggctcgatttcaacgatacctggctggcagcggagtgggggcatccttccgacaacctcggcggcattctggcaacggcggactggctttcgcgcaacgcggtcgccagcggcaaagcgccgttgaccatgaaacaggtgctgaccggaatgatcaaagcccatgaaattcagggctgcatcgcgctggaaaactcctttaaccgcgttggtctcgaccacgtcctgttagtgaaagtggcttccaccgccgtggtcgccgaaatgctcggcctgacccgcgaggaaattctcaacgccgtttcgctggcgtgggtggacggtcagtcgctgcgcacctatcgccatgcgccgaacaccggcacgcgtaaatcctgggcggcgggcgatgctacttcccgcgcggtacgtctggcactgatggcgaaaaccggcgaaatgggttatccgtcagccctgactgcgcctgtgtggggcttctacgacgtctcctttaaaggcgaatcgttccgcttccagcgcccgtatggttcttacgtgatggaaaatgtgctgttcaaaatctccttcccggcggagttccactcccagacggcagttgaagcagcgatgacgctctatgaacagatgcaggcagcaggcaaaacggcggcggatatcgaaaaagtgaccattcgcacccacgaagcctgtattcgcatcatcgacaaaaaagggccgctcaataacccggctgaccgcgaccactgcattcagtacatggtggcgatcccgctgctgttcgggcgcttaacggcggcagattacgaggacaacgttgcgcaagataaacgcatcgacgccctgcgcgagaagatcaattgctttgaagatccggcgtttaccgctgactaccacgacccggaaaaacgcgccatcgccaatgccataacccttgagttcaccgacggcacgcgctttgaagaagtggtggtggagtaccccattggtcatgctcgccgccgtcaggatggcattccgaagctggtcgataaattcaaaatcaatatcgcgcgccagttcccgactcgtcagcagcagcgcattctggaggtttctctcgacagaactcgcctggaacagatgccggtcaatgagtatctcgacctgtacgtcatttaagtaaacggcggtaaggcgtaagttcaacaggagagcattatgtcttttagcgaattttatcagcgttcgattaacgaaccggagcagttctgggccgagcaggcccggcgtattgactggcagacgccctttacgcaaacgctcgaccacagcaacccgccgtttgcccgttggttttgtgaaggccgaaccaacttgtgtcacaacgctatcgatcgctggctggagaaacagccagaggcgctggcattgattaccgtctcttcggaaacagaggaagagcgtacctttacctttcgtcagctgcatgacgaagtgaacgcggtggcctcaatgttgcgttcattgggggtgcagcgtggcgatcgggtgctggtgtatatgccgatgattgccgaagcgcatattactctgctggcctgcgcgcgtattggcgctattcactcggtggtgtttggtggatttgcctcgcacagcgtggcggcgcgaattgatgatgctaaaccggtgctgattgtctcggctgatgccggagcgcgcggtggcaaaatcattccctataaaaaattactcgacgatgcgataagtcaggcgcagcatcagccgcgccacgttttactggtggatcgcggactggcgaaaatggcgcgcgtcagcgggcgggatgtcgatttcgcgtcgttgcgccatcaacacatcggtgcgcgggtgccggtggcgtggctggaatccaacgaaacctcctgcattctctacacctccggcacgaccggcaaacctaaaggtgtgcagcgtgatgtcggcggatatgcggtggcgctggcgacctcgatggacaccatttttggcggcaaagcgggcggcgtgttcttttgtgcttcggatatcggctgggtggtagggcattcgtatatcgtttacgcgccgctgctggcggggatggcgactatcgtttacgaaggattgccgacctggccggactgcggcgtgtggtggaaaattgtcgagaaatatcaggttagccgcatgttctcagcgccgaccgccattcgcgtgctgaaaaaattccctaccgctgaaattcgcaaacacgatctttcgtcgctggaagtgctctatctggctggagaaccgctggatgagccgaccgccagttgggtgagcaatacgctggatgtgccggtcatcgacaactactggcagaccgaatccggctggccgattatggcgattgctcgcggtctggatgacaggccgacgcgtctgggaagccccggcgtgccgatgtatggctataacgtgcagttgctcaatgaagtcaccggcgaaccgtgtggcgtcaatgagaaagggatgctggtagtggaggggccattgccgccaggctgtattcagaccatctggggcgacgacgaccgctttgtgaagacgtactggtcgctgttttcccgtccggtgtacgccacttttgactggggcatccgcgatgctgacggttatcactttattctcgggcgcactgacgatgtgattaacgttgccgggcatcggctgggtacgcgtgagattgaagagagtatctccagtcatccgggcgttgccgaagtggcggtggttggggtgaaagatgcgctgaaagggcaggtggcggtggcgtttgtcattccgaaagagagcgacagtctggaagaccgtgaggtggcgcacttgcaagagaaggcaattatggcgctggtagacagccagattggcaactttggccgcccggcgcacgtctggtttgtctcgcaattgccaaaaacgcgatccggaaaaatgctgcgccgcacgatccaggcgatttgcgaaggacgcgatcctggggatctgacgaccattgatgatccggcgtcgttggatcagatccgccaggcgatggaagagtaggtcggataaggcgctcgcgccgcatccgacaccgtgcgcagatgcctgatgcgacgctgacgcgtcttatcatgcctacccactgtttttacacagataagtttcccccgcctttttgcactcattcatataaaaaatatatccccctacgaaaacgattgctttttatcttcagatgaatagaatgcggcggattttttgggtttcaaacagcaaaaagggggaatttcgtgtcgcaagataacaactttagccaggggccagtcccgcagtcggcgcggaaaggggtattggcattgacgttcgtcatgctgggattaaccttcttttccgccagtatgtggaccggcggcactctcggaaccggtcttagctatcatgatttcttcctcgcagttctcatcggtaatcttctcctcggtatttacacttcatttcttggttacattggcgcaaaaaccggcctgaccacccatcttcttgctcgcttctcgtttggtgttaaaggctcatggttgccttcactgctgctgggcggcacccaggttggctggtttggcgttggcgtggcgatgttttctattccggtgggcaaggcaaccgggctggatattaatttgctgattgccgtctccgatttactgatgaccgtcaccgtcttctttggcatttcggcgctgacagttctttcggtgattgcggttccggctatcgcctgccttggcggttattccgtgtggctggccgttaacggcatgggcggcctggacgtattaaaagcggtcgttcccgcacaaccgttagatttcaatgtcgcgctggcgctggttgtggggtcattcatcagtgcgggtacgctcaccgctgactttgtccggtttggtcgcaatgccaaactggcggtgctggtggcgatggtggcctttttcctcggcaactcgttgatgtttattttcggtgcagcgggcgctgcggcactggggatggcggatatctctgatgtgatgattgctcagggcctgctgctgcctgcgattgtggtgctggggctgaatatctggaccaccaacgataacgcgctctatgcgtcgggtttaggtttcgccaacattaccggtatgtcgagcaaaaccctttcggtgattaacggtattatcggtacggtctgcgcattatggctgtataacaattttgtcggctggttgaccttcctttcggcagctattcctccagtgggcggcgtgatcatcgctgattatctgatgaaccgtcgccgctatgagcactttgcgaccacgcgtatgatgagtgtcaattgggtggcgattctggcggtcgcgctggggattgccgcaggccactggttaccgggaattgttccggtcaacgcggtattaggtggcgcgctgagctatctgatccttaacccgattttgaatcgtaaaacgacagcagcaatgacgcatgtggaggctaacagtgtcgaataatgctttacaaacaattattaacgcccagttacccggcaaagaggggctgtggcagattcatcttcacgacggaaaaatcagcgccattgatgcgcaatccggggtgatgcccgtaactgaaaacagcctggatgccgaacaaggtttagttttaccgccgtttgtggagccgcatattcacctggacaccacgcaaaccgccggacaaccgaactggaatcagtccggcacgctgtttgaaggcattgaacgctgggccgagcgcaaagcgttattaactcatgacgatgtgaaacaacgcgcatggcaaacgctgaaatggcagattgccaacggcattcagcatgtgcgtacccatgtcgatgtctccgacgcaacgctgactgcgttgaaagcgatgctggaagtgaaacaggaagttgcgccgtggattgatctgcaaatcgtcgccttcccgcaggaagggattttgtcgtatcccaacggtgaagcgttgctggaagaggcgctacgcttaggggcagatgttgttggggcgattccgcattttgaatttacccgtgaatacggcgtggagtcgctgcataaaaccttcgccctggcgcaaaaatacgaccgtctcatcgacgttcactgtgatgagatcgatgacgagcagtcgcgctttgtcgaaaccgttgctgccctggcgcaccgtgaaggcatgggcgcgcgagtcaccgccagccatactacggcaatgcactcctataacggggcgtatacttcgcgcctgttccgtttgctgaaaatgtccggtattaactttgtcgccaacccgttggtcaatattcatctgcaaggacgtttcgatacgtatccaaaacgtcgcggcatcacgcgcgttaaagagatgctggagtccggcattaacgtctgctttggtcacgatgatgtcttcgatccgtggtatccgctgggaacggcgaatatgctgcaagtgctgcatatggggctgcatgtttgccagctgatgggctacgggcagattaacgacggcctgaatttaatcacccaccacagcgccaggacgttgaatttgcaggattacggcattgccgccggaaacagcgccaacctgattatcctgccggctgaaaatgggtttgatgcgctgcgccgtcaggttccggtacgttattcggtacgtggcggcaaggtgattgccagcacacaaccggcacaaaccaccgtatatctggagcagccagaagccatcgattacaaacggtaatcggctgggttaccgcgagcgtagtttatgccggatgcggcgtgaacaccttatccggcctacgtagatctctgaaattgtaggcctgataagcggagcgcatcaggcaattttgcttatttaaactgaagactcaactttaaaatctttgaaataatattgcttatcccggtcgtttatttcgcgaataacccgacaaggaacgccagcagccacgacgtttggtggaatgtcttttgtgacgacactacccgcgccaataacagaattatccccgatggtgacgcctggattaataaccacatgacttccgatccagacgttattgccaatcgttatcggaaaagagtacatctctccgttttttctcaattcatggtgtaccgggtgtcccgtaacggaaagagtaacgttgggtgcaatcagtacgttatcaccgatcgttaccgtgtagtcgtcgacaatggttaaattgaaatttgcataaaaattgcggcctatatagatgttggaaccgtaagagaaatagacggggggttctacccaggcgttttcccctaccgtggcaaacatttctttaatcagactttctcttttatcaacttctgatggatgcgagtgattaaactcatacattaacgtttttccacgaagtcttttttcaggtaagccttcgcacatatcggtaaatagcttgcctgcttttattctttctgtcatcgacatgttcattgcgatcattccgccctgatatgttggtcggataaggcgctcgcgccgcatccgacattgattgcttaagcgacttcattcacctgacgacgcagcaaggaaagcgggccggggccgctaagcgtgaacacggaaattaaggtgaagcccagcgccaccagacccagcaccagataagcgccctggaaaccgatgctttcatacatattgcccgccagtacagacataaaaatcatcgccagttgcttaaagaagcagaaacagaccagataaatcgtcgctgaaaaacgcacttcaaactggctggtaatatatttaaagcagcccaccagcaggaacggtacttcaaacatatgcagcgttttcagaataaccacttccagcgctgaggtggcgaacgatgagccaataatacgtacagacataatagtgccagccagcagcagggcattttttccaccgatgcgattaatgatcagtggcgcaaagaacataatcgaggcattaagtaattcgcccattgtcgttacgtagccaaatacccgcgtaccctgttcaccggtagcaaaaaacgaagtaaagaaattagcaaactgttggtcaaaaacatcgtaggtgcaggaaacgccaataacatacagtgacaaaaaccacagttttggctgtctgaacagttccagcgccagcttaaggctaaatgccgaatggttggcacctaccgcattggcaaccgtggctgaagagggcgcatccgttttggcgaaaaagagtaaaacggcgaggatgagtgcacagccagaacccagccagaaaacaaactgattattgatggtgaacatgatgccgacaatcgaggcacacagcgcccagccaacacagccaaacatccgcgcgcgaccaaattcgaaattactgcgacggctgactttctcgataaatgcctctactgctggcgcaccggcgttaaaacaaaagccaagataaataccaccaacaatcgatcctactaaaatgttgtattgtaacagtggtccgaagataaaaataaagaatggcgcaaacatcactaacatgccggtaataatccacagcaggtatttgcgcagcccgagtttgtcagaaagcagaccaaacagcggttggaataatagcgagaacagagaaatagcggcaaaaataatacccgtatcacttttgctgatatggttgatgtcatgtagccaaatcgggaaaaacgggaagtaggcccccatgataaaaaagtaaaagaaaaagaataaaccgaacatccaaaagtttgtgttttttaaatagtacataatggatttccttacgcgaaatacgggcagacatggcctgcccggttattattatttttgacaccagaccaactggtaatggtagcgaccggcgctcagctggaattccgccgatactgacgggctccaggagtcgtcgccaccaatccccatatggaaaccgtcgatattcagccatgtgccttcttctgcgtgcagcagatggcgatggctggtttccatcagttgttgttggctgtagcggctgatgttgaactggaagtcgccgcgccactggtgtgggccataattcaattcgcgcgtcccgcagcgcagaccgttttcgctcgggaagacgtacggggtatacatgtctgacaatggcagatcccagcggtcaaaacaggctgcagtaaggcggtcgggatagttttcttgcggccccaggccgagccagtttacccgctctgcgacctgcgccagctggcaggtcaggccaatccgcgccggatgcggtgtatcgcttgccaccgcaacatccacattgatgaccatctcaccgtgcccatcaatccggtaggttttccggctgataaataaggttttcccctgatgctgccacgcgtgggcggtcgtaatcagcaccgcgtcggcaagtgtatctgccgtgcactgcaacaacgccgcttcggcctggtaatggcccgccgccttccagcgttcgacccaggcgttagggtcaatgcgggtcgcttcacttacgccaatgtcgttatccagcggcgcacgggtgaactgatcgcgcagcggggtcagcagttgtttttcatcgccaatccacatctgtgaaagaaagcctgactggcggttaaattgccaacgcttattacccagctcgatgcaaaaatccgttccgctggtggtcagttgagggatggcgtgggacgcggaggggagtgtcacgctgaggttttccgccagacgccattgctgccaggcgctgatgtgtccgccttctgaccatgcggtcgcgtttggttgcactacgcgtaccgttagccagagttgtccggcgctctccggctgcggcagttcaggcagttcaatcaactgcttaccttgcgggccaacatccagaggcacttcaccgcttgccagcggcttgccatccagcgccaccgaccagtgcaggagttcgttatcgctatgacggaacaggtattcgctggtcacttcgatggttcgcccggataaacggaactggaaaaactgctgctggtgttttgcttccgtcagcgccggatgcggcgtgcggtcggcaaagaccagaccgttcatgcagaactggcgatcgttcggcgtatcgccaaaatcaccgccgtaagccgaccacgggttgccgttttcatcatatttaatcagcgactgatccacccagtcccagacgaagccgccctgtaaacgggggtactgacgaaacgcctgccagtatttagcgaagccgccaagactgttacccatcgcgtgggcatattcgcaaaggatcagcgggcgcatttctccaggcagcgaaagccattttttgatggaccatttcggcaccgccgggaagggctggtcttcatccacgcgcgcgtacatcgggcaaataatatcggttgcggaggtgtcggctccgccgccttcatactgtaccgggcgggaaggatcgacagatttgatccagcgatacagcgcgtcgtgattagcgccgtggcctgattcattccccagcgaccagatgatcacactcgggtgattacgatcgcgctgcaccatccgcgttacgcgttcgctcatcgcgggtagccagcgcggatcatcggtcagacgattcattggcaccatgccgtgggtttcaatattggcttcatccaccacatacaggccgtagcggtcgcacagcgtgtaccacagcggatggttcggataatgcgaacagcgcacggcgttaaagttgttctgcttcatcagcaggatatcctgcaccatcgtctgctcatccatgacctgaccatgcagaggatgatgctcgtgacggttaacgccgcgaatcagcaacggcttgccgttcagcagcagcagaccattttcaatccgcacctcgcggaaaccgacatcgcaggcttctgcttcaatcagcgtgccgtcggcggtgtgcagttcaaccaccgcacgatagagattcgggatttcggcgctccacagttccggattttcaacgttcaggcgtagcgtgacgcgatcggcataaccgccacgctcatcgataatttcaccgccgaaaggcgcggtgccgctggcgacctgcgtttcaccctgccacaaagaaaccgtcacccgcagttcatcgcgcagctcgccgtacatctgaacttctgcctccagtaccgcgcggctgaaatcatcattaaagagagtggtaacttggaaatcgctgatttgcgtggtcggtttatgcagcaacgagacgtcacggaaaatgccgctcatccgccacatatcctgatcttccagataactgccgtcactccagcgcagcaccatcaccgcgaggcggttttctccggcgcgtaaaaatgcgctcaggtcaaattcagacggcaaacggctgtcctggccgtaaccgacccagcgcccgttgcaccacagatgaaacgccgagttaacgccatcaaaaataattcgcgtctggtcttcctgtagccagctttcatcaatattaaatgtgagcgagtaacaacctgtcggattctccgcgggaacaaacggcggattgaccgtaatgggataggtcacgttggtgtagataggcgcatcgtaaccgtgcatctgccagtttgaggggacgacgacagtatcggcgtcaggaagatcgcactccagccagctttccggcaccgcttctggtgccggaaaccaggcaaagcgccattcgccattcaggctgcgcaactgttgggaagggcgatcggtgcgggcctcttcgctattacgccagctggcgaaagggggatgtgccgcaaggcgattaagttgggtaacgccagggttttcccagtcacgacgttgtaatacgacggccagagaatccgtaatcatagtcatagctgtatcctgtgtgaaattgttatccgctcacaatttcacacaacatacgagccggacacatagagtgtaaagactggtgtgcctaatgagtgagctgactcacattaattgtgttgcgctcactgcccgctttccagtcgggaaacttgtcgtgccagctgcattaatgaatcggccaacgcgcggggagaggcggtttgcgtattgggcggaagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacacgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcatttagcatttgcatggtttgttgaaaaccggacatggcactccagtcgccttcccgttctgttatcggctgaatttgattgcgtgtgagatatttatgccagcccgccagacgcagacgcgccgagacagaacttaatggacctgctaacagcgcgatttgctggtgacccaatgcgaccaggtgctccacgcccagtcgcgtaccgtcttcatgggagaaaataatactgttgatgggagtctggtcagagacatcaagaaataacgccggaacattagcgcaggcagcttccacagcaatggcatcctggtcatccagcggatagttaatgatcagcccactgacgcgttgcgcgagaagattgtgcaccgccgctttacaggcttcgacgccgcttcgttcaaccatcgacaccaccacgctggcacccaattgatcggcgcgagatttaatcgccgcgacaatttgcgacggcgcgtgcagggccagactggaagtggcaacgccaatcagcaacgactgtttgcccgccagttgttgtgccacgcggttgggaatgtaattcagctccgccatcgccgcttccactttttcccgcgttttcgcagaaacgtggcaggcctggttcaccacgcgggaaacggtctgataagagacaccggcatactccgcgacatcgtatagcgttactggtttcacattcaccaccctgaattgactctcttccgggcgctatcatgccataccacgaaaggttttgcgccattcgatggtgtcagcgtaaatgcacgccgcttcgccttcccgctaccagaatagcctgcgattcaaccccttcttcgatctgttttgccacccgttgtagcgccggaagatgcttttccgctgcctgttcaatggtcattgcgctcgccatatacaccagattcagacagccaatcacccgttgttcactgcgcagcggtacggcaatagaggcgatcttttcttcttgatcccagccgcggtagttctgtccgtacccctctttgcgcgcgcgcgccagaatggcttccagatttaacggttcccgtgccagttgatagtcatcaccggggcgggaggctaacatctcgattaattccttgcgttcttgttccgggcaaaaggccagccaggtcaggcccgaggcggttttcagaagcggtaaccgtcgcccgaccattgcccggtgaaaagataagcggctgaaacgatgggtggtttcgcgtaccaccattgcatcaacatccagggtggacacatctgtcggccataccacttcgcgcaacagatcgcccagcagtggggccgccagtgcagaaatccactgttcgtcacgaaatccttcgcttaattgccgcactttgatggtcaaacggaaactatcatcggagggactacgccggacatatccctcttcctgcagcgtctccagcagtcgccgcacagtggtgcgatgcaggccgctgagttccgccagcagcccgacgctggcaccgccatcaagtttacttaacatatttaataacattagaccgcgggttaagccgcgcacggttttgtattccgtctgctcattgttctgcatattaattgacatttctatagttaaaacaacgttgtgcacctggtgcacattcgggcatgttttgattgtagccgaaaacacccttcctatactgagcgcacaataaaaaaatcatttacatgtttttaacaaaataagttgcgctgtactgtgcgcgcaacggcattttgtccgagtcgtgaggtactgaaatggcaatacaacaccctgacatccagcctgctgttaaccatagcgttcaggtggcgatcgctggtgccggtccggtcgggctgatgatggcgaactatctcggccagatgggcattgacgtgctggtggtggagaaactcgataagttgatcgactacccgcgtgcgattggtattgatgacgaggcgctgcgcaccatgcagtcggtcggcctggtcgataatgttctgccgcacactacgccgtggcacgcgatgcgttttctcaccccgaaaggtcgctgttttgctgatattcagccaatgaccgatgaatttggctggccgcgccgtaacgcctttattcagcctcaggtcgatgcggtgatgctggaaggattgtcgcgttttccgaatgtgcgctgcctgttttcccgcgagctggaggccttcagccagcaagatgacgaagtgaccgtgcacctgaaaacggcagaagggcagcgggaaatagtcaaagcccagtggctggtggcctgtgatggtggggcaagttttgtccgtcgcaccctgaatgtgccgtttgaaggtaaaactgcgccaaatcagtggattgtggtagatatcgccaacgatccgttaagtacgccgcatatctatttgtgttgcgatccggtgcgcccgtatgtttctgccgcgctgcctcatgcggtacgtcgctttgaatttatggtgatgccgggagaaaccgaagaacagctgcgtgagccgcaaaatatgcgcaagctgttaagcaaagtgctgcctaatccggacaatgttgaattgattcgccagcgtgtctacacccacaacgcgcgactggcgcagcgttttcgtattgatcgcgtactgctggcgggcgatgccgcgcacatcatgccggtgtggcaggggcagggctataacagtggtatgcgcgacgcctttaacctcgcatggaaactggcgttggttatccaggggaaagcccgcgatgcgctgctcgatacctatcaacaagaacgtcgcgatcacgccaaagcgatgattgacctgtccgtgacggcgggcaacgtgctggctccgccgaaacgctggcagggtacgttacgtgacggcgtttcctggctgttgaattatctgccgccagtaaaacgctacttcctcgaaatgcgcttcaagccgatgccgcaatattacggcggtgcgctggtgcgtgagggcgaagcgaagcactctccggtcggcaagatgtttattcagccgaaagtcacgctggaaaacggcgacgtgacgctgctcgataacgcgatcggcgcgaacttcgcggtaattggctggggatgcaatccactgtgggggatgagcgacgagcaaatccagcagtggcgcgcgttgggcacacgcttcattcaggtggtgccggaagtgcaaattcataccgcacaggataaccacgacggcgtactacgcgtgggggatacgcaaggtcgcctgcgtagctggttcgcgcaacacaatgcttcgctggtggtgatgcgcccggatcgctttgttgccgccaccgccattccgcaaaccctgggcaagaccctgaataaactggcgtcggtgatgacgctgacccgccctgatgccgacgtttctgtcgaaaaggtagcctgatatgcacgcttatcttcactgtctttcccactcgccgctggtggggtatgtcgacccggcacaagaggtactcgatgaggtcaatggcgtgattgccagcgcccgcgagcgtattgcggctttctcccctgaactggtggtgctgtttgcgccagatcactacaacggctttttctatgacgtgatgccaccgttctgtttaggcgttggagcgacggcaattggtgatttcggcagtgcggcaggtgagctgcccgtgcctgtggagctggcggaggcctgtgcgcatgccgtcatgaagagcggaatcgatcttgccgtttcttactgtatgcaggtggaccacgggttcgcccagccgctggagttcctgctcggtgggctggataaggtgccagttctgcctgtgttcatcaacggtgtcgccacgccgctgcccggtttccagcgtacccgcatgttgggtgaagccattggacgtttcaccagcactctcaataaacgcgtgctgttccttggggccggtgggctttcccatcagccgccggtgccagaactggcgaaagccgatgcccatatgcgcgaccgtctgttggggagcgggaaagatttacccgccactgagcgtgaattgcgtcagcagcgggtgattagcgccgctgagaagtttgttgaggatcagagaacgctgcatccgctcaacccgatttgggataaccagttcatgactttgctggagcagggacgcatacaggaactggatgccgtcagtaacgaagagctttccgccattgccggaaagtcgacacatgaaatcaaaacctgggtcgccgcttttgccgctatttctgcgtttggcaactggcgtagcgaagggcgttattaccgcccaatcccggagtggattgccggatttggctcgttaagcgccagaacagagaactgaatatgcaggagaagatgatgagttatcagccacaaaccgaagccgccaccagccgttttctgaatgtagaagaagcgggtaaaacgctgcgcatccattttaatgactgcggacaaggcgacgaaactgttgtcctgctgcatggttccggcccgggtgctactggctgggcgaacttcagccgcaatatcgatccgctggtaaaggcgggctatcgggtgatcctgctggattgtccgggttggggtaagagcgattcgatcgttaatagtggttcacgatcggatcttaatgcgcgaatcctgaaaagcgtggtggatcaactggatatcgccaaaatccacctgctaggcaactcgatgggcggccatagttctgtggcgttcacccttaactggccggagcgcgtcggcaaactggtgctgatgggcggtggtacgggcggcatgagtttgtttacgccgatgccaaccgaaggtattaagcgactgaatcagctttatcgtcagccgactatcgaaaacctgaagctgatgatggatatcttcgtttttgataccagcgatttgaccgacgccctgtttgaagcgcgcctgaataatatgctgtcgcgccgcgatcacttggaaaatttcgttaagagcctggaagctaatccgaaacagttcccggattttggcccacgtctggcggaaatcaaagcgcaaaccctgattgtctgggggcgcaacgaccgctttgtgccgatggatgcgggtctgcgtctgctgtccggcattgccggttctgaactgcatatcttccgcgactgtggtcactgggcgcagtgggaacatgccgacgctttcaatcaactggtgctgaatttcctcgcacgtgcttaaggaacggtcatgacgaagcatactcttgagcaactggcggcggatttacgccgcgccgcagagcagggcgaagcgattgcgccgctgcgcgatctgattggtatcgataacgctgaagcggcctacgtcatattgcacataaatgtgcaatatgacgttgcgcaggggcgtcgcgtggtggggcgtaaagtgggcctgacacatccgaaagtgcagcaacaactgggcgttgatcaaccggatttcgggacattatttgccgacatgtgttatggcgataacgaaaccattcctttttcccgtgttctgcaaccccgcattgaagcggagatcgcactggtgttgaaccgcgatttacccgcaactgatatcaccttcgacgaattgtataacgccattgaatgggtacttccggcgctggaggtggtggggagccgcattcgcgactggtcgattcagtttgtcgataccgtggcagataacgcctcctgtggggtgtatgtcatcggcggtccggcgcaacgtccggcggggttagacctgaaaaactgcgccatgaagatgacgcgtaataacgaagaggtttccagcgggcgcggcagcgaatgcctgggacatccgcttaatgccgccgtctggctggcacgcaaaatggccagcctgggtgaaccgctgcgcgccggagatatcattcttaccggggcattaggtccgatggtggcggtgaatgcgggcgatcgttttgaagcccatattgaaggcataggttcagttgctgcgacattttcaagcgcagccccaaaaggaagtctgtcatgagtaagcgtaaagtcgccattatcggttctggcaacattggcaccgatctgatgattaaaattttgcgtcacggtcagcatctggagatggcggtgatggtcggcattgatcctcagtccgacggtctggcgcgtgccagacgtatgggcgtcgccaccacccatgaaggggtgatcgggctgatgaacatgcctgaatttgctgatatcgacattgtatttgatgcgaccagcgcgggcgcgcatgtgaaaaacgatgccgctttgcgcgaagcgaaaccggatattcgcttaattgacctgacgcctgctgccatcggcccttactgcgtgccggtggttaacctcgaggagaacgtcgatcaactgaacgtcaacatggtcacctgcggcggccaggccaccattccaatggtggcggcagtttcacgcgtggcgcgtgttcattacgccgaaattatcgcttctatcgccagtaaatctgccggacctggcacgcgtgccaatatcgatgaatttacggaaaccacttcccgagccattgaagtggtgggcggcgcggcgaaagggaaggcgattatcgtgcttaacccagcagagccaccgttgatgatgcgtgacacggtgtatgtattgagcgacgaagcttcacaagatgatatcgaagcctcaatcaatgaaatggctgaggcggtgcaggcttacgtaccgggatatcgcctgaaacagcgcgtgcagtttgaagttatcccgcaggataaaccggttaatttgccgggcgtggggcagttctccgggctgaaaacggcggtctggctggaagtcgaaggcgcagcgcattatctgtctgcctatgcgggcaacctcgacattatgacttccagtgcgctggcgacagcggaaaaaatggcccagtcactggcgcgcaaggcaggagaagcggcatgaacggtaaaaaactttatatttcggacgtcacgttgcgtgacggtatgcacgccattcgtcatcagtattcgctggaaaatgtccgccagattgccaaagcactggatgatgcccgcgtggattcgattgaagtggcccacggcgacggtttgcagggttccagctttaactatggtttcggcgcacatagcgaccttgaatggattgaagcggcggcggatgtggtgaagcacgccaaaatcgcgacgttgttactgccaggaatcggcactattcacgatctgaaaaatgcctggcaggctggcgcgcgggtggttcgtgtggcaacgcactgtaccgaagctgatgtttccgcccagcatattcagtatgcccgcgagctcggaatggacaccgttggttttctgatgatgagccatatgaccacgccggagaatctcgcaaagcaggcaaagctgatggaaggctacggtgcgacctgtatttatgtggtggattctgacggtgcgatgaacatgagcgatatccgtgaccgtttccgcgccctgaacgcagtgctgaaaccagaaacgcaaaccggcatgcacgctcaccataacctgagtcttggcgtggcgaactctatcgcggcggtggaagagggctgcgaccgaatcgacgccagcctcgcgggaatgggcgcgggcgcaggtaacgcgccgctggaagtatttattgccgccgcggataaactgggttggcagcatgggactgatctctatgcgttaatggatgccgctgacgacctggtgcgtccgttgcaggatcgaccggtacgagtcgatcgcgaaacgctggcgctgggatacgctggtgtttactccagcttcctgcgtcactgtgaaacggcggcggcgcgttatggcttaagcgcggtggatattctcgttgagctgggcaaacgccggatggttggcggccaggaggatatgatcgtcgacgtggcgctggatctgcgcaacaacaaataatattgactgccgagaacgtgcattttgtatgcccatcccagcacgactgccggatgcggcgtgaacgccttatccggcctacatttcgcccgtaggcagtcattaaatagttctgattacgcggctggtaatgtatcagtcgcgattcacctgcactcgcaatgaggttcatcttatgtcgactcgtaccccttcatcatcttcatcccgcctgatgctgaccatcgggctttgttttttggtcgctctgatggaaggactggatcttcaggcggctggcattgcggcgggtggcatcgcccaggctttcgcactcgataaaatgcaaatgggctggatattcagcgccggaatactcggtttgctacccggcgcgttggttggcggaatgctggcggaccgttatggtcgcaagcgtattttaattagctcagttgcgctgtttggtttgttctcactggcaacggcgattgcctgggatttcccctcactggtctttgcgcgactgatgaccggtgtcgggctgggggcggcgttgccgaatcttatcgccctgacgtctgaagccgcggggccacgttttcgtgggacggcagtgagcctgatgtattgcggtgttcccattggcgcggcgctggcggcgacgctgggtttcgcgggggcaaacttagcatggcaaacggtgttttgggtaggtggtgtggtgccgttgattctggtgccgctattaatgcgctggctgccggagtcggcggtttttgctggcgaaaaacaggctgcgccaccactgcgtgcgttatttgcgccagaaacggctaccgcgacgctgctgctgtggttgtgttatttcttcactctgctggtggtctacatgttgatcaactggctaccgctgcttttggtggagcaaggattccagccatcgcaggcggcaggggtgatgtttgccctacaaatgggtgcggcaagcgggacgttaatgttgggcgcattgatggataagctgcgtccagtaaccatgtcgctactgatttatagcggcatgttagcttcgctgctggcgctgggaacggtgtcgtcatttaacggtatgttgctggcgggattcgtcgcggggttgtttgcgacaggtgggcaaagcgttttgtatgccctggcaccgttgttttacagttcgcagatccgcgcaacaggtgtgggaacagccgtggcggtagggcgtctgggggctatgagcggtccgttactggccgggaaaatgctggcattaggcactggcacggttggcgtaatggccgcttctgcgccgggtattcttgttgccggcctggcagtgtttattttgatgagccggagatcacgaatgcagccgtgcgccgatgcctgacgcgccttattaagtaggggcgaaagggacttgcccccaatacacctacggcgtttacaggtatactcgctaaaaattattcagcgggtttggaaacaaagatggcaaaacttaccttacaagagcagttgctcaaagcgggactagtcaccagcaaaaaagcggcgaaggtggagagaacggcgaaaaaatcgcgtgttcaggcgcgtgaagctcgggcggcggtagaagaaaataaaaaggcacagcttgagcgtgataaacagcttagcgagcaacaaaaacaagcggcgttggcgaaagaatataaagcccaggtgaagcagctcattgaaatgaaccgaattaccattgccaatggcgatattggttttaacttcactgacggcaatctgattaagaaaatctttgtcgataaaatcacgcaaacgcagttgattaatggtcgtctggcgattgcccgcttgttggtcgataacaataacgaaggtgaatacgccattattcccgccagcgttgccgataaaattgctcagcgtgatgccagcagtattgtgttgcacagcgcgctcagcgccgaagagcaggatgaagacgatccgtatgccgacttcaaagtgcctgatgatttgatgtggtaaacatagataaatcgtgtgcagatgcctgatgcgacgctttgcgagtcttatcaggcctacggtttatgggcgaagtgtaggccggataaggcgttcacgccgcatccggcagccgtgcgcagatgcctgatgcgacgcttttcgcgtcttatcaggcctacggtttacgagcgaaatgtgggccggataaggcgtttacgccgcatccggcagtcgtgcactattatcaacgcatattcagtttattggcgtggtacgcaatatgctcgccaataaaactggagacaaaataatagctgtgatcataaccctcgtgataacggattaacgtcttgatattcatctcctggcagatcttttcaagatttggagtccgcagctgttctgcgtaaaaatcatcactcaatccctgatcaaccatgatttccgcaacgcgttgaccttgtgaaataagactcaccgggtcgtaatccaaccaggcatctttattttcaccaagatatgcggcaaaggcttgctgtccccacggtacttgcgatggggagacaatgggcgaaaacgccgagacgctggcatattcatctgggttacgtaacgccagcaccagcgcgcccagcccgcccatagaatgacctgagatagactttctggccgttgctggaaaatgatgcatcactaaattcggcagctcgttgcggatatagtcatacattttgtaatgttcattccacggcgcttgcgtcgcgttcaggtaaaacccggcaccttgcccgagatcgtaacggtcagcatctgcgacatgactgcctcgcggactggtgtccggcgcaacaacaataatgttgtgctcagccgcgtaacgctgcatccccgatttagtaatgaaattctgctcgttgcaggtcaggcctgaaagccagtacaacaccggcaatttttcattctcggcttttggtgggagatagacgccgacattcatttcacatttcagtgatggggaataatgccgatacacattttgccagccgccaaagctggcatgtttttcaatgagttccatcagtcattatctcacggttaatcccccggacggctgcccggggagagtattaagaaccccgtctgaactggacggggtaaaccagcgggaaatcagtaacgaattacggttcgaatggatttaccttcatgcatcaggtcgaaggcgtcattaatttcatccaggctcatggtatgcgtgacaaacggttccagatcgatatcacctttcatcgcatcttcaaccatacccggtaactgggaacgacctttcacgccgccaaacgcggaacctttccatacgcgaccggtgaccaactggaatggacgggtggagatttcctgaccggagcctgctaccccgatgatcaccgactgaccccagccgcggtgcgcgctttccagcgctgcacgcatcacgttgacattaccgatgcattcaaaggtatggtcgataccccatttgttgatatccagcagaacatctttaattggtttgtcgtagtcattcgggttaatgcagtcggtggcaccgaagcgacgcgccagttcgaatttcttcgggttggtatcgatagcgataatccgtcccgctttcgcctgacgcgcgccctgaaccactgccagaccaatcgcgccaagaccaaacacggcaacagaatcacctggctggactttagctgtgttgtgtaccgcgccaataccggtggtcacgccacagcccagcaggcagacgtgttcatggtttgcttctggattaattttggccagagacacttccgctaccacggtgtattcactgaatgttgagcatcccatgtagtgataaagcggctgcccgttgtaagaaaaacgggtggtgccgtctggcatcaagcctttgccctgcgtttcgcgaaccgcgacacacaggttggttttgccagaacgacagaactcacactcgccgcactctgcggtgtaaagcgggatcacatggtcgccaggtttgacgctggttacgccttcaccgacttcaacaacaaccccggccccttcgtgaccgagaaccactgggaagacaccttccgggtcatcgccggagagggtaaatgcgtcggtatggcaaacaccggtatgggtgactttaatcagcacttcaccttttttcggtggtgcaacgtcaatttcaacgatttccagcggtttaccgggagcaaatgcaacggcagcacgtgatttcatctctcgctcttcctcaatatggtaatagattcagctatttaagataggcacgaaccagttcaatagtgtcgtcaacggattggctgacttcgcggctgtagcagtcatttcggtcaaacgtttcccggatatggctttcaagcacttctgccatcagtccgttagccgcgccccgaacggcagcgatctgttggagtatggcacggcattcggcatcaccctccagcgaccgttccagagcatcaatctgcccccgaatacgacgaactcgagtaaggacctttttcttctcttccggagtactgggcatttcgcacctcatcatctgcacgcaatatactataggggggtatgctatatgtcaatgcatacccccctatagtatataacactggagaataaaatttatccggtgaatgtagtcggaaaacaaagaggaaaggggataggggctaatcggcagggaaggccgccccggatagcgggcggcagaaggaatcagaatttccaggtcagatgggctgcaagttgcagaccgttataatcatcggttggggtgtcgtaccacactttacctgccgtcaacccgagattaagttgctcagtcagcggttgaatacgttgcaaactgatgctcttcatgctgccgtagcgtgtttctggcgtccagtcgtaggtgtaagcacctgttccgcggcttagccatagttgcgtgtaaccagtgcgcgcgggtcattcagacgcacggaaatcatattgctgtaactaccacctgcatcgctggagtcataatgggtatagcgatagctggtgatcaccgggccagtatagagtgatatgccaccttgccaggcatcgacttcgacatcatcgtaatatttagtgtagcgataaccggtcgtgaaaagcgtttttggcaacagggccaggttaatatcctgacgaaaatcctggcgggcaaagaccggcgtattatccgcaaaggcaatacccgttcgggttgtcagccagttattccatttgtaccagactgcaccctggccgcgagtggcattgaaatgttcagtttcataatcacgacgcccctgggaaagattaaaaagcagcgttgcgttttcaactttcgccaccagttcagcatacgctaaattacggttgccatgatcgccagaataatcggtaaaatcgtagcccgcggtaatggaagttaacccggcataaacgggtaatgcgctaaaaattgccgccgctaataacgtccgttttatcattttaatctcctgtacggataagttcttgtcggagtgaataagttccggtaggtaaattacgttctacaatcacgcgcgggccaagctgcgtgttcggggaaataattcgcccaggcaaaataataacttgtacgccaaggcgtgaacgctgcccgatataacaacctaatttatcgcatccggtagcgataattccatctggagttcgaacagacacgggctgttcatccagacgatgattactggttcgtacttgtgcgcccaaatatgcctggtttgcaactaccgagtcggcaataaagcattgcggaccaatcgttgcttccgcttcaataaccgcatttttaatttcggtggcaaaaccaatttttacgccattgctgattattgtgccaggacgaataaacgcataattacctatcaggcagtttgtgccaatcactaccggaccctgaataacggcaccgtggcaaatacgggtattcgtgccgataacaacctcaccggcactttcatcaataatcacctggtctgcaatctgaatatttttctctttaacattaagcttcagatagtttttcagttcctgtgacagaagggtgggaataagcggttgacgcttccaccagtgcggaatagcgggtgggtttgtcgcgctgaggttcgcgtccagtaaaaaaggcaataagtccataaataatccagatggcataagctaataatacatacacaacggaaagcggtgctaaaggcaccaacaaccagcaacgatgaaaccaggcgctaaatgcaccaataacacaaactacgccgacccagataagcgggaacattgccaacaccacaccatgtggcccggtggtgatgaattcattaaaccaggtagtgagataaataccaacgccataaagcacaaccaacagcataggaaatatactgaagataccgaagcggctaaataaaagtcttttatgcaggcgcatacagaccgcgtagcccacaatccaacgccgccagcggcgccactcctcacgcggactgttacattcctgtgggtatacgatgcagcgattcgcctgccgaatacggtagccgtttgccaccaatgtccaggtgagatcaaggtcttcgactttagtacgatccgagaaaccgaacttacgcaatacatcagtacggaacatcccgcaggcaccgctgatgataaacggtgcgccgcccagaagctgctgtagcgtgcgcttcataacaatcatcggcaactttacggtcgcgcggatgtgtggtaacagacccgcgcctttcaacgcagtagagggaatgccgcctacggcatcagcgccacgctcaatttccgccagcatatagcccattccgtcttgatcgggcggaacataggtgtcggcatcacttaaaaaaacctgatcgcaggtggcgtaattgaggccattcatcagcgcaccacctttaccggtatttttttgcgtgacggcaacaaagcggtcgccccatttgcgtttgacttccgccatgaccgcttcggtattgtccgtggagccgtcgttaacgcaaattacccggcaaaaataagggttacgcagcagattatccagtgactgcgccagacacgggccttcgttataagcaggtataatggcgtcaatacagcctttcttttggctgggcttacgccttaacgtactcagaaaccatagcaatattgctacggccatacatataaagatccaggttttcatgcaatttgctcaaagaatcattttatgaataacaaaaccttcacccagatcgctattgacctgttgcccgcgaaattgagcaactgcacgcagacgctccgggcgcatataatctcgctggctctgacttttatgtttttttaacgcagtcagtttaagagaaaaatattcttctttcacggattcaaaaacctgaggcataaatgaaagccaggtacttggtgtttcatagccgagaatttgcggaatagcgcgacaggcaaccattgaggcttgatagactgcaagatgatcctgatggcggtcagcatcatgcatggtatatacacgtataatttcaacatcagagggaatttgattttttatgatgttttccagggcagaaatcatatcattgagctgtaaatgagcgcgggtgtcagcaaaattaagatgaatagtttggtggcaccctaatatctttagagcgttgcgtgattcttcgtggcgatcgattattccatctacgccagaattaccggtagtcatcaccacggtagcaatataaattcctttttgcgcaaggcgagctagcgatgcgccacagcctaattctatatcgtcaggatgcgcgccaatggcaaggataccctttcttttatttgccgaagaaaggatcgctgaatctaaaaccttatccactttatgacactccattttatttattatactacaagcacaacgacgcccccagagacgtaacctctgacgcagacagatgctaatttttaagtgttaaaaatagctgatagctgaaaaacaaggggctgtcaggtacggggataagagtgtgtaatcttttatgtagttcatatgttaagtgtttgtgtgtttggtttgtatggttattttgttttatatattgtatttaaatgtgatttagtttgtcaattaattgcatattaaaaatatgttctatgcacaaatattgattatatacattatgtgaatacattatgtggttgattgagaatgatacatttatatatgcaatgtgaatataatggtttcattatatgtgttgctgttaataaaataacagacattagaacctgcttgtttatgcattaataaaatgaagtgcagtaatttactgagttatcagagtgggcgtaattgcatatttaatctttcctttgccgcttttttgctaagaataaaattatctgtacgataacgactaattcttttaatgaatgtttttattcctgaatactgctcccataacaagacgggggagcagacaatcatggcaatttcatcgcgtaacacatttcttgccgcactggcatttatcgcttttcaggcgcaagcggtgaacgtcaccgtggcgtatcaaacctccgccgaaccggcgaaagtggctcaggccgacaacacctttgctaaagaaagcggagcaaccgtggactggcgtaagtttgacagtggagccagcatcgtgcgggcgctggcttcgggcgacgtgcaaatcggcaacctcggttccagcccgttagcggttgcaaccagccaacaggtgccgattgaagtcttcttgctggcgtcaaaactgggtaactccgaagcgctggtggtaaagaaaactatcagtaaaccggaagacttgattggtaaacgcatcgccgtaccgtttatctccaccacccactacagcttgctggcggcgctgaaacactggggtattaaacctgggcaagttgagattgtgaacctgcagccgcccgcgattatcgccgcatggcagcggggagatattgatggtgcttatgtctgggcaccggcggttaacgccctggaaaaagatggcaaggtgctgaccgattctgaacaggtcgggcagtggggcgcgccgacactggacgtctgggtcgtgcggaaagattttgccgagaaacatcctgaggtcgtgaaagcgttcgctaaaagcgccatcgatgctcagcaaccgtacattgctaacccagacgcgtggctgaaacagccggaaaacatcagcaaactggcgcggttaagcggcgtgccggaaggtgacattccggggctggtgaaggggaatacctatctgacgccgcagcagcaaacggcagaactgaccggaccggtgaacaaagcgatcatcgacaccgcgcagtttttgaaagagcagggcaaagtcccggctgtagcgaatgattacagccagtacgttacctcgcgcttcgtgcaataaaaggaggcgcagatgctgcaaatttctcatctttacgccgattatggcggcaaaccggcactggaagatatcaacctgacgctggaaagcggcgagcttctggtagttctggggccgtctggctgcggcaaaactacgttgctgaatttgattgctggttttgtgccttatcagcatggcagcattcaactggcgggtaagggtattcagggaccgggagcagagcgtggcgtagtttttcagaatgaagggttgttaccgtggcgcaatgtacaggacaacgtggcgttcggcctgcaactggcaggtgtagagaaaatgcagcgactggaaatcgcacaccagatggtgaaaaaagtcgggctggaaggcgcagaaaaacgctacatctggcagctttccggtggtcaacgtcagcgggtggggattgcccgcgcgttggcggcaaatccccagctgttattactcgacgaaccgtttggtgcgctggacgccttcacccgcgaccagatacaaaccctgctgctgaaactctggcaggagacgggaaagcaggtgctgttgattacccacgatatagaagaagcggtgtttatggcgactgaactggttctgctttcacccggcccaggccgcgtgctggagcggctgccgctcaacttcgcccgccgctttgttgcgggagagtcgagccgcagcatcaagtccgatccacaattcatcgccatgcgcgaatatgttttaagccgcgtatttgagcaacgggaggcgttctcatgagtgtgctcattaatgaaaaactgcattcgcatcggctgaaatggcgctggccgctctcgcgtcaggtgaccttaagcattggcacgttagcgattttactcactgtatggtgggtagtcgcggcgctgcaactgattagcccgctgtttttgccgccaccgcaacaggtactggcaaaactgctcaccattgccgggccgcagggatttatggacgccacgctgtggcagcatctggcagccagcctgacgcgcattgtgctggcgctactcgcggcggtgttgatcggtattccggtcgggatcgccatggggctaagcccgacggtgcgcggcattctggatccgataatcgagctttatcgtccggtgccgccgctggcttatttgccgctgatggtgatctggtttggtattggcgaaacctcgaagatcttactgatctatctagcgatttttgcgccggtggcgatgtcggcgctggcgggggtgaaaagcgcgcagcaggttcgcattcgtgccgcccagtcgctgggtgccagccgtgcgcaggtgctgtggtttgtcattttgcccggcgcgctgccggaaatcctcaccggattacgcattggtctgggtgtgggctggtctacgctggtggcggcggagctgattgccgcaacgcgcggtttaggatttatggttcagtcagcgggtgaatttctcgcgactgacgtggtgctggcggggatcgcggtgattgcgattatcgcctttcttttagaactgggtctgcgcgcgttacagcgccgcctgacgccctggcatggagaagtacaatgagtgaacgtctgagcattaccccgctggggccgtatattggcgcacaaattacgggggccgacttaacgcgcccgttaagcgataatcagtttgaacagctttaccatgcggtgctgcgccatcatgtggtgtttctgcgcgatcaagctattacgccgcagcagcaacgcgcgctggcccagcgttttggcgagctgcatattcaccctgtttaccctcatgctgaaggggttgacgagatcatcgtcctggatacccataacgataatccgccggataacgacaactggcacaccgatgtgacatttattcaaacgccacccgcaggggcgattctggcggcgaaagagttaccctcgaccggcggcgatacgctctgggccagtggtattgccgcatatgaggcgctctctgttcccttccgccagctgttgagcgggttgcgtgcggagcatgatttccgtaaatcgttcccggaatacaagtaccgcaaaaccgaggctgagcatcaacgctggcgtgaggcggtcgcgaaaaatccaccgttgctacatccggtggtgcgaacgcatccggtgaccggtaaacaggcgctgtttgtgaacgaaggttttaccacacgaattgttgatgtcagcgagaaagagagcgaagccttgttaggttttttgtttgcccatatcactaaaccggagtttcaggtgcgctggcgctggcaaccgaatgatattgcgatttgggataaccgcgtgactcagcactatgccaatgcggattacctgccacagcggcggattatgtatcgggcgacgattcttggggatattccgttttatcgggcggggtaagggggaaatgccgggttggataacccggcataatgatcattaacgcagaatcttcttctcagccaaatccagcgcaaagtagctgaaaatcagatccgcacccgcacgtttaatcgaacctaagctttcgagcacgactttctcttcatctatagcacccgccagcacggcgaacttaatcatcgcgtactcaccgctcacctgatacgcgccaatcggcaattcagtacgttcacgcagctcacgcacgatgtcgaggtatgctccggcaggtttaaccatcaggcagtctgcgccctgggcttcatccagcagcgactcacgaatcgcctcacgacggttcattgggttcatctgatagcttttgcggtcgccttttaatgcgcttccggcagcttcacggaacgggccataaaaggaggaggcgaacttggtcgaatacgacataatcgccgtatctttaaagcccgcagcgtccagcgcctggcgaatcgcctgtacctgaccatccatcgcggcagaaggggcgatgaagtctgcgcctgcagcagctgcaaccacagcttgcttgcctaaattttccagagtcgcgtcgttgtcgacgccatgctcgcacagaacaccgcagtgaccgtgagatgtgtattcacagaagcaggtgtctgacataacgatcatttctggcacggtctgcttgcagatgcgcgacatacgcgccaccagtccatcttcccgccaggcatcgctgccggtttcatcggtatggtgagagatgccgaaagtcatcacggaacgaataccggcgttggcgatgcgttcaatttcgcgtgccagatgtttctctggaatgcgcatcacgcctggcatggcttcaacggctttgtagtcgtcaatttcttcttcaacaaagatcggcaacaccaggtcgttaaggctaagtgttgtctcttcaaacatagcgcgcagcgcaggagatttgcgcaggcgacgagggcgttggattaaatctgtcatggtctgcctgatgtttgtggaatcgaggagcatagtatacctgaagcaggctgggtgtgttttacgaaagttgtcgcgatgttgacaaaaagagaatgaaaaagaggtcaggacatctttgtaatagaaatagcaataatttcatattcactgaaaataggtaatgactccaacttactgatagtgttttatgttcagataatgcccgatgaccttgtcatgcagctccaccgattttgagaacgacagtgacttccgtcccagccttgccagatgttgtctcagattcagattatgtcgctcaatgcgctgagtgtaacgcttgctgataacgtgcaactttcccttcaggcgtgattcatacagcggccagccatccgtcatccataccacgacctcaaaggccgacagcaggctcagaagacgctccagtgtggccagagtgcgttcaccgaagacgtgcgccacaacagtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtaccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattacccatcaacgtacacgtatatcgcgttctgtcgttgcggaagttctcgctgctttgcgtaaaggcggctatatcgaaatgaataaaggcaaactggtcgctatcaaccgtttgccttcagagtattaatcaggatgcggggataaccaacggtttattcccgcttagctcggtcaccaggtcattgatgtcatcgctcatatttttaaagcgcgtcaacggcgaacgagtgaccaccacaaacgcgccaatattcttctgcgggatcatcgccatataggtaatgaaaccgccaccaccacctgtcttctgaataatccccggacgaccctctttcggggccatatatacccagcctaaaccaagcgcatccgctttgccggggacatccatgccaatcacttttgtaaactgcgcgcgctgataaatcaacgtctgcatgcgatcagcctggttactgcgctgataaaaatcagatgacaaatactgctgcatccagcgcatcatatcgcctggcgtggaatagacgccgccgctgccaattgccgccagcgtgttattgcacggactggcaccgcgctcagcaaccattaaacggcggcactgatccggtgagggggtgtaggtggtgtctttcatccccaacggacgggtaatctgctcttcaaacaactgggtataaggcttgccggacgcattcgccagtgcatctgccagcagatcgaatgcgaggttggagtacgcggcctggctgcccggcgcggcttttagtttggcagtggaaaggtatttccagcgttgctcgcgcgttggccagacaaataccggacgatgtgccgcgccaccgggctgttcacggggcagggcgctggtatgggttgccagattcaccagcgtaatgggcgtcccattgtaggtcggtacacgtgcgcctggcggagcatatttacttagcggatcgtttaacttcacggtcccctggtcgagcaatttcaccagcatctcactggtcattaacttggtgagggaagcaatacgtatgacggaatccagctgcgggcgaacgttattaccaggtcgcgtttcgccataactgcgaaagacgcgctggttaccgtcgataacaaccagcgccatccccgtggcaccgctgccgtaaaaaatatgatcggcataacgatcgacaatatcagaggcaaactccggttcagtgatcggctgcgccgcatggacggaggtcaatgacgccgcatacagcacggcagaaaaaagcagactacgtttcaacggtggtgtccatagattgaatgaaggtaactgagcgtatttatactactcattgatggattgcaaagggcgaattagtgcaataatagtgttaaaaacgtaacggcgcgtaaacacgatctttttcctgctcaccaatgcctgcatttgtgatcctgcgcgtgttaatccgcttatgtaaacaatctttggtttgtgaaacccgtcgaaacaattcttatggtcaggctggcgaactaagcgccttgctatgggtcacaatgggcggtttcatttggctgacgctttgtagcggtcatgcggttaatacacagcagttgttaaaacgataagaagttagcaggagtgcatatgtttaagtcttttttcccaaagccgggaacgttttttctctcggcctttgtttgggcattgattgccgttatcttctggcaagccggtgggggtgattgggtggcgcgtatcaccggcgcttccgggcagatcccgattagcgccgcgcgtttctggtcgttggatttcctgattttttacgcttactacattgtttgcgtaggactttttgcattgttctggtttatctatagcccgcaccgttggcaatactggtcaatactcggtactgcgctgattatctttgtcacctggtttttggtggaagtcggggttgccgtcaacgcctggtatgcgccgttctatgatctgattcaaacggcgctaagttcgccgcataaagtcaccatcgaacaattttaccgcgaagtgggcgtctttctggggattgcgctgatcgcggtggtgatcagtgtgctgaacaacttctttgtcagtcactacgtgttccgctggcgtacggcgatgaacgaatattacatggcgaactggcaacaactgcgtcatatcgaaggggccgcgcagcgtgtgcaggaagacaccatgcgttttgcttcaacgctggagaatatgggcgtcagctttatcaacgctatcatgacgttgatcgccttcctgccggtgctggtaacgctctccgcacatgtgccggagctgccgattgtcgggcacattccgtatggtctggtgattgccgctatcgtctggtcgctgatggggaccggattactggcagtggtagggatcaaactgccggggctggagtttaaaaaccagcgtgtagaggctgcctaccgtaaagagctggtttatggtgaagacgatgccacgcgcgcgacgccgcctacggtacgcgagctttttagcgccgtacggaaaaactatttccgcctctattttcactatatgtatttcaatatcgcccgcattctctatttgcaggtcgataacgttttcggtttgttcttgctgtttccgtcaattgttgccggtacgattacactcggcctgatgacgcagattactaacgtttttggtcaggttcgcggtgctttccagtacctgattaactcatggaccacactggttgagttgatgtctatctacaaacgtctgcgcagctttgaacatgagctggatggtgacaaaattcaggaagtaacccataccttgagctaaaaaggagaagtaatgtcgcgcgtcaatcatctatcttcgctgtcattgttggcggttctggttttagcggggtgtagtagtcaggctccgcaaccgttgaaaaagggcgaaaaagcgatagatgtggcgagcgtcgtgcggcagaagatgcctgcgagcgtgaaagaccgcgatgcttgggcgaaagatctcgccaccacctttgaaagtcaggggttggcaccgacgctggaaaacgtctgctcggtgctggcggtggcgcagcaggagtcaaattatcaggcagatccggccgttccgggcttaagcaagatcgcctggcaagagattgaccgtcgtgctgaacggatgcacattcctgcttttctggtgcataccgcgctaaaaatcaaatcgccaaacggcaaaagctatagcgaacggttagattcggtgcgtactgaaaagcaattgagcgcgatttttgacgatctgatcagcatggtgccaatggggcagacgttgtttggttcgcttaatccggtgcgcaccggtgggccgatgcaggtcagcattgcttttgccgaacagcataccaaggggtatccgtggaaaatggacggtacagtccgtcaggaagtcttcagtcgtcgcggcgggttgtggtttggtacttaccatttactgaattatcccgccagctatagcgcgccgatataccgttttgctgattttaacgctggctggtacgccagccgtaatgccgcgtttcagaacgcggtcagtaaggccagcggcgtgaagctggcactggacggtgatttaattcgttacgacagtaaagagcccgggaaaaccgaactggcaacgcgcaaactggcgggaaaactggggatgagcgacagtgaaattcgccgccagttagagaaaggcgacagcttctcttttgaggagacggcgctgtacaagaaagtttatcaacttgccgaagcgaaaacgggtaaatcactaccccgcgaaatgttgcctggcattcaactggaaagcccgaaaatcacccgcaacctgactacggcctggtttgcgaagcgcgtagacgaacggcgggcgcgttgtatgaaacagtgatcaaacaggaatgtcatgccagataaagcgttttaggtcctatctggcaagtaaatcttactggcggcgatgtcgccagtgcagccatagcgccactactgcaaaaatgaggcagccaactaaaaacgggatcagcccgaaaatggtgccgacacctaaaccaatttccacccgtgggcgacctgtttcctggacctgcattaaacgctcatagacgccgggcgcatgcactagcaggttcagcaattgcgccccagcccaaaagcaaaacagcacaaacaacgcataggcaatattgccaggcgttgaagaggcattgcgatattttccgctaaacagcgattttgacagggtgaaatcagccataaaaacctccggaagtcatctgcttctcttctggtgtgataccatcggcttatggcaagtctgacaggtcattaagattgtcaatatcagaatcatggtaaattgatgttgggaatattcccgaagcgtgaatcttcgtcgtgagtcacaaaatgacaaccttaagttaaatttattaacaattacggaaatgttgtctacgccacagacggatgttgcagaatatgcaaggatgttgtttttcgttaacggagctgccatgaacttgcctgtaaaaatccgccgtgactggcactactatgcgttcgccattggccttatattcattcttaatggcgtggtggggttactgggatttgaagcaaaaggttggcagacctatgccgtcggtctggtgacgtgggtgattagtttctggctggcggggttgattattcgtcgtcgcgatgaagaaactgaaaacgcccaataagaatattaccgggcgtttgaatattacattgtggttttcagtgcgttatccgcagcgtgacgctccagcgccagctcaatcaaacgcgtgatcaggtcggtgtaacccagaccgctggcttgccacagcttcggatacatactgatgttggtgaagccaggcagtgtgttgatctcgttgatcaccacttcgttctctggggttaaaaatacgtctacacgcgccatgcctgcgcatcccaacgtttgataggcctgaacggcaatcgcccggatcttatcgttgatttctggcgcaatggctgccggaacaaccactttcgcgccatcttcgtcaatgtacttggtgtcgtaggcatagaaatcgctggtgagtacgatctcgccacaggtgctggcttgcggattgtcgttgcccagaactgcgcattcgatctcacgacctttgatcccttgctcaacgatcactttatggtcgaactcgaacgccagatcgacggcaattgcgtactgttcttcactagttactttgctgacaccaacagaagagccctgattagccggttttacaaacagcggtaaccccagtttagactccacttcggcaaaactgatgttgtgacgattagcgcgcgtcagggtaataaatggcgcaatgttcagcccggcatcgcgcagcagacgtttggtgacatctttatccatacaggccgctgaagccagaacatcagaacctacaaacggtaaattggcgacccgcagcattccctgcaaggaaccatcttcgcccagcgtaccgtggacaatagggaaaatgacatccaccgtcggcaacggctgaccgttttgtgcgtcgataagctgatgctcatgtttacctggcacctgcgcaaggctggtcgccgaagggcgcaacgcaatatgggcaggatcgtctgcatttagcagataattgttggcatcgctgacgtgccattgcccttgtttatcaatgcccagcagcacaacatcgaagcgacttttatcaatggcatcgacaatgttttttgccgattgcagagacacttcatgttccgctgatttaccaccaaaaacgattcctacccgcagtttttccatcttaaaaacctatcccgtctaacacaaagtgcatacattaccacgacaaaacgggggattcgcggccttctgacagaatgttgcaatcttctgctgacaaagcgagcaacgtactggtgaagaaagtgcgttatctcaaagatgtgtgcaagatcacaaaaatgatgaacgggaagctaatttattcctggcttaaatgaccatgtggtgagtttttttctcttaattataagataacgaagagaatatatttcataacttttatttataataaaggttgataattaaaggcctatattttatgtgggtaattatttaaataagagaaacgtttcgctggtaatcaaacaaaaaatatttgcgcaaagtatttcctttgtcataaaaataatacttccagacactatgaagttgtgaaacataatgttaacttctccatactttggataaggaaatacagacatgaaaaatctcattgctgagttgttatttaagcttgcccaaaaagaagaagagtcgaaagaactgtgcgcgcaggtagaagctttggagattatcgtcacggcaatgcttcgcaatatggcgcaaaatgatcaacagcggttgattgatcaggtagagggggcgctgtacgaggtaaagcccgatgccagcattcctgacgacgatacggagctgctgcgcgattacgtaaagaagttattgaggcatcctcgtcagtaaaaagttaatcttttcaacagctgtcataaagttgtcacggccgagacttatagtcgctttgtttttattttttaatgtatttgtacatggagaaaataaagtgaaacaaagcactattgcactggcactcttaccgttactgtttacccctgtgacaaaagcccggacaccagaaatgcctgttctggaaaaccgggctgctcagggcgatattactgcacccggcggtgctcgccgcttaacgggtgatcagaccgccgctctgcgtgattctcttagcgataaacctgcaaaaaatattattttgctgattggcgatgggatgggggactcggaaattactgccgcacgcaattatgccgaaggtgcgggcggcttttttaaaggtatcgatgccttaccgcttaccgggcaatacactcactatgcgctgaataaaaaaaccggcaaaccggactacgtcaccgactcggctgcatcagcaaccgcctggtcaactggtgtcaaaacctataacggcgcgctgggcgtcgatattcacgaaaaagatcacccaacgattctggaaatggcaaaagccgcaggtctggcgaccggtaacgtttctaccgcagagttgcaggatgccacgcccgctgcgctggtggcgcatgtgacctcgcgcaaatgctacggtccgagtgcgaccagtgaaaaatgtccgggtaacgctctggaaaaaggcggaaaaggatcgattaccgaacagctgcttaacgcccgtgccgatgttacgcttggcggcggcgcaaaaacctttgctgaaacggcaaccgccggtgaatggcagggaaaaacgctgcgtgaacaggcacaggcgcgtggttatcagttggtgagcgatgctgcctcactgaattcggtgacggaagcgaatcagcaaaaacccctattaggactgtttgctgacggcaatatgccagtgcgctggcaaggaccgaaagcaacgtaccacggtaatatagataagcccgcagtcacctgtacgcctaatccgcaacgtaatgacagtgtaccgaccctggcgcagatgaccgacaaagccattgaattgttgagtaaaaatgagaaaggctttttcctgcaagttgaaggtgcgtcaatcgataaacaggatcacgctgcgaatccttgtgggcaaattggcgagacggtcgatctcgatgaagccgtacaacgggcgctggaattcgctaaaaaggatggtaacacgttggtcatagtcaccgctgatcacgcccatgccagccagatagttgcgccagataccaaagctccgggcctcacccaggcgctaaataccaaagatggcgcagtgatggtgatgagttacgggaactccgaagaggattcacaagaacataccggcagtcagttgcgtattgcggcgtatggcccgcatgccgccaatgttgttggactgaccgaccagaccgatctcttctacaccatgaaagccgccctggggctgaaataaaaccgcgcccggcagtgaattttcgctgccgggtggtttttttgctgttagcaaccagacttaatgacagatcacgggcgcatacgctcatggttaaaacatgaagagggatggtgcgatgaaaattacattactggttaccttgcttttcggtctggtttttttaaccaccgtcggcgctgccgagagaaccttaaccccacaacaacagcgtatgacctcttgtaatcagcaggcgacggcgcaggcgttgaaaggggatgctcgtaagacctacatgagtgattgcctgaagaacagcaaatctgcgcctggtgaaaaaagtttgacgccacagcagcaaaagatgcgcgaatgtaataatcaagcaacacaacaatctctgaaaggggatgatcgtaataagtttatgagtgcctgcctcaagaaagccgcctgatacctgatagtgctaacgggtgagctacgaaaatggctcacccgaaatttcatacttctgcctttagccccgtctctataatttgggaaaattgtttctgaatgttcccaaaaataatgaatgatgaaaactttttcaaaaaagcggcggcgcatggggaggaacctcctttaactcctcaaaacgaacatcagcggtccgagctgcgctttgcccgtcgcgtcagactaccccgcgcggttggcctggctggcatgttcttaccgattgcttcaacgctggtttcgcatccgtcgccgggctggtggtggctgttgttggtcggctgggcgttcgtctggccgcatttagcctggcaaatagcgagcagggccgtcgatccgcttagccgggaaatttacaacttaaaaaccgatgcagtattagcgggaatgtgggtaggcgtaatgggcgtaaacgcactgccttccaccgcgatgttgatgattatgtgtctgaatttgatgggggcaggcggcccccgtctgtttgtcgcgggtctggtgttgatggtggtctcctgccttgtcaccctcgagctgacgggcatcaccgtgtcgttcaatagcgcaccgctggaatggtggctctcccttcccattattgtcatttatcctctgctgtttggctgggtcagctaccagacggcgactaaactggcggaacataaacgcaggttgcaggtcatgagtacccgcgacggtatgacgggcgtgtataaccgacgtcattgggaaactatgttacgcaatgaatttgataactgtcggcggcataatcgcgatgcaacgttactgattatcgatatcgaccatttcaagagcatcaacgatacctggggccatgatgtgggtgatgaagcgattgtggcgcttacccgacagttacaaattaccctgcgcggtagcgatgtgattggtcggtttggcggcgatgagtttgcagtaatcatgtccggtacgccagctgagagcgccatcaccgccatgttacgggtgcatgaagggctaaacacgttacgcttgccgaatacgccacaggtaactttacggattagtgtgggggttgcgccgctgaatccacaaatgagtcactatcgcgagtggttgaaatcggcagatttggcgctctacaaagcaaagaaagccggacgtaaccgcaccgaagtggcggcctgacgtccggcaaaagccatcaggatttgctgagtttttctgatttttccatacacttcgtcatcgcttcgatcactgcggcacggaagcctttctcttccagtacgcgtaccgcctcaatggtggtgcctcccggtgagcagaccatatctttcagtgttcccggatgttctcccgtttccagcaccatttttgcggagcccattaccgcctgagcggcaaatttatacgcctgggcgcgtggcatcccgcccagcacggcggcgtcggccatcgcttcgataaacataaagacgtaggctggcgaagaaccgctcacaccgaccaccgggtggatcatcggctcagcaatcacttccgcttcgccaaagcagcggaaaatattcagcacatcagcggtatcttctggggttaccagcgcgtttggcgttacggaggtcatcccggcattaaccagcgcgggagtgttcggcatggcgcggataattttccggtcatggcccagcgcgcgggcaagctggtcgagcgtgatacctgcagcaatagaaacgaccagagagtctttattcaggctggaggtgatttcgctaagcactttaatcatgatgcctggtttaacggcggcaaaaatgatgtcggcgatttgcgctacttcttgcgccgattctgcggcgttgatgccgaactggtcatgcagggcggtgactttatccggggagggggtatatacccagatttgccctggaaacacctgaccgctggcaatcagaccgctgagaatggcttttcccatattgccgcagccaataaaaccgattttcttttccattgcctcactcctgccgtgaaatttattgttttgataatcgctggcagaagcataaacagaactatgccggaaggcaaaagcgcgacacaatagaggattacccaacaaaggatgactttatgacaatttgggtggatgccgacgcgtgtcccaatgtaattaaagagattttgtatcgcgcggcggaacgtatgcagatgccgctggtactggtagcaaaccagagtttacgcgtgccgccatcgcgatttattcgtacgctgcgcgtcgcggcaggtttcgacgttgccgataacgaaattgttcggcagtgtgaagcgggcgatttggtgatcaccgcagatatacctttggctgctgaagccatcgagaaaggcgcggcggcgcttaatccgcgcggcgaacgttacacgccagcgaccattcgtgagcgcctgacgatgcgcgattttatggataccttacgtgccagtgggatccagaccggaggaccagatagtctttcacaacgtgaccgccaggcctttgctgcggagctggagaagtggtggctgaaagtgcaacgtagtcgtggctaaatgtaatttattatttacacttcattcttgaatatttattggtatagtaagggatgtattgagatttccaccttaagtggaattttttctttacaatcgaaattgtactagtttgatggtatgatcgctattctcatgacaccggctttcgccgcattgcgacctattggggaaaacccacgatgacacaacctctttttctgatcgggcctcggggctgtggtaaaacaacggtcggaatggcccttgccgattcgcttaaccgtcggtttgtcgataccgaccagtggttgcaatcacagctcaatatgacggtcgcggacatcgtcgaaagggaagagtgggcgggattccgcgccagagaaacggcggcgctggaagcggtaactgcgccatccaccgttatcgccacgggcggcggcattattctgacggaatttaatcgtcacttcatgcaaaataacgggatcgtggtttatttgtgtgcgccagtatcagtcctggttaaccgactgcaagctgcaccggaagaagatttacggccaaccttaacgggaaaaccactgagcgaagaagttcaggaagtgctggaagaacgcgatgcgctatatcgcgaagttgcgcatattatcatcgacgcaacaaacgaacccagccaggtgatttctgaaattcgcagcgctctggcacagacgatcaattgttgattttcgagcgcctatacttaacgttcatcccgtgaaataaggaagaacgatgccaacgaaaccgccttatcctcgtgaagcatatatagtgacgattgaaaaaggaaagccaggacagacggtaacctggtaccaactcagagccgatcatcctaaaccagactcgttgatcagtgaacatccgaccgctcaggaagcgatggatgcgaaaaaacgctatgaggaccctgacaaagagtgaccgcatcagactgctcggaagggattctgagtgccgccacaagggatctgcgtcacatttttcacaattcatgtttttcaaataattagaatattaaacaataacaatccattactggaatcatttggaatctttacattatgcagtgcaggtctgctgctacgctttttgtcatttgtagcacaggtaagtgtcagcagtggtgcttagcgcttgcccggtaattaacgacgaaagaaaagtaaggtggaagaacaatgagtgcgtcgttggcgatcctgaccatcggcattgtacctatgcaggaagttttgccgctcctgacagaatacattgacgaagataatatttcccatcatagcctgctggggaagttaagccgcgaagaagtgatggcggagtacgcgccagaagcaggcgaagacaccattctcacattattaaatgacaaccagctggcccatgtttcgcgtcgtaaagtggaacgagacctgcaaggtgtggttgaagtgctcgataatcagggttatgacgtcattttattaatgagtacagcaaacattagtagtatgaccgcgcgtaatacgatctttcttgagccgtcgcggatattgccaccgctggtttcctctattgttgaagatcatcaggtgggggttatcgtaccggttgaggagttgctgaccgttcaggcgcaaaaatggcaaattttgcagaaaccgccagtattttcattgggtaatcccattcatgattcggaacaaaaaatcattgatgccgggaaagaattactggcaaaaggtgcagatgtcatcatgctggattgtttgggatttaaccagcgtcatcgcgatttactgcaaaaacagctcgatgttcctgtcttgctctctaacgtattgattgcacggctggctgcggaattactgatgtaattttgcgtgacagtcagcgcctctggcccctatagtgaagtagatgttcaactaccagacagggccagtttatgcttcaaagtaatgagtacttttccggcaaagtgaaatcgatcggcttttccagcagcagcactggtcgcgccagcgtgggtgttatggttgaaggtgaatacaccttcagcaccgctgagcctgaagagatgacggtaatcagtggcgcgctgaatgtgttactgcctgacgcgaccgactggcaagtgtatgaagccggttcggtgtttaatgttcccggtcacagcgagtttcatctgcaagttgccgaacccacctcttatctgtgccgctatctgtaattcctcgccttccccttgaacgggagggcatttttctgaaatgtcctctctttaacccataataatatttcctttgctgggattttttcgatttccgatatattcataattcatcaaggttgatataaatatcagcgaagatctccagatattgttgcggaactggcgacgttaaaagataaatcagatgatgaatggtggtgtgcattgctgcaaagtcgcaatgatcatttgcgccaaacggcattgcacaacgcacatactccggtgttgttaacgacattgactgagcctcaggagcggtcgctggctattaataattcacagctggctgcggatgtgaaaacgacgtggttaaaagaggagccatcattactcttatttgtcgaacaacccgatttttcgctgttacgtgatttagtgaaaaacggggcaacgcggaaaattcgcagtgaagcgcgtcaccggcttgaggaaaaacaatgacacaacgcccctggagcaagttacagcataaaacgcataatattgctgcgctaagaattattgcccgctgtagctaacgattatattcctggtgtggcttcgtacgccggataagacgcggcaggcgtcgcatccggcattaaaggtaaatcagcaattaacgttgtgcttcgccacctaatccttcaatcaggttttgaattaacgctgccagttcaccagtcatcaggatgaaatcggcatcaaaacgctgggcgaaatcttcacggtcgatatcttcgttttgatcgcgcagctcgtcgcagaacttcagacgcttgagcgaaccatcgtcgcacatcacaaactgaatgcgctgctgccagtcgagcgccagtttagtcaccacttttccggcttcaatgtggttggtgatctcttcgctggtcagatcttgtttcttcgcgcggatcacgccgccatcttccagcaacgatttcagctcggcttcatcaagcagctggaagccctgtgccgtgctgccggaacgtacccattcggtcagcgtcagttcaatcgggttttccatgctcaatggtacaaccggtaacgaccccaggcttttacgcagcagtgccagcgtatcttccgcttttttggcgctggcgcagtccaccataatcaaaccgttaaccgtgtcgatccacatcattgtctggctaaaacggctgaaagcacgcggcagcagagagtgcagcacttcgtctttcagcgaatctttttcggttttcttcagcttacgcgcctgttccgcttccagtttggcgattttcgcttccagcgcctgtttaatcaccggggacgggaggattttttcttctttgcgcgcacagataacaatttgaccattggcaacgtgcgttaacgcatcgctgtgcgatcccatcggaggtacccagcccatcttcgccatgtcctggctgccgcatggggtaaatgccatcgaggctagctgtttttccatctcttctgcacgcagcgaaatctcgcggctaagacggtaaaccattaaatttttgaaccacagcatgataatttccacggccttgtcgttaaatttagcgggcatgataacgaattgtcggcggccttgcattgccaatccggttgtccgtctctacgctattgatattgaaaaaaataaggagagtaccgtgcgtataggtatcgatttaggcggcaccaaaactgaagtgattgcattgggcgatgcaggggagcagttgtaccgccatcgtctgcccacgccgcgtgatgattaccggcagactattgaaacgatcgccacgttggttgatatggcggagcaggcaacagggcagcgcggaacggtaggtatgggcattcctggttcgatttcgccctacaccggcgtggtgaagaatgccaattcaacctggctcaacggtcagccattcgataaagacttaagcgcgcggttgcagcgggaagtgcggctggcaaatgacgccaactgtctggcggtttcagaagcggtagatggcgcggcagcgggagcgcagacggtatttgccgtgattatcggcacgggatgcggcgcgggcgtggcattcaatgggcgggcgcatatcggcggcaatggcacggcaggcgagtggggacacaatccgctaccgtggatggacgaagacgaactgcgttatcgcgaggaagtcccttgttattgcggtaaacaaggttgtattgaaacctttatttcaggcacgggattcgcgacggattatcgtcgtttgagcggacatgcgctgaaaggcagtgaaattatccgcctggttgaagaaagcgatccggtagcggaactggcattgcgtcgctacgagctgcggctggcaaaatcgctggcacatgtcgtgaatattctcgatccggatgtgattgtcctgggcggcggaatgagcaatgtagaccgtttatatcaaacggttccgcagttgattaaacaatttgtcttcggcggagaatgtgaaacgccggtacacaaggcgaaacatggtgattcgagcggcgtacgcggcgctgcatggttatggccacaagagtaaaaaacccaggcaattggcgtatcatgcctgatgcgacgcttgccgcgtcttatcaggcctacaaagtgagccgtccggtaggccggataaggcgctcgcgccgcatccggcaacaaataacgcgcacagtggcggcaaccccccggtgctccgatgcctgatgcgacactggcgtgtcttatcaggcctacaaaatgaacagtcccgtaggccggataaggcgttcacgccgcatccggcaacaagcgatgcgcactgcgactgctatctaccccagtggtttcgctagcaccgaactatccgccgcttgctggcgcttatagcgaccatacagcagcaacgacgacatcgcagcaaacgaaagcagggcagcgggcagcgccacgtaattatatgccagccccagcgtcagcatcataccaccgcaatatgcgccgacggcgctaccgaggttaaacgctatttgcccacctgcggcacctaataactctccgcctttggcattttgcagtaataatatttgtagaggtgctgatagggcaaataatcccgcgcaacaaataaaagcaaaaataagcgacgttgttttcataccgccgaagaaaaagagcatcagcagtgccagtacaatgataaagtcagtcactgctgcaatgcgcagtggtgaataacgtcctgaaatcctgccacttagcatattccccagcaccatccctagcccaactaacatcataataaaggtcatcgccgtttccgaaaaaccggaaataaacatcatgtatggctttacgtagctgaaccaggcaaacacacctgcgttgccaaacatcgtagcggcgaaaattaaccacggggcagggctgcgtaaaaaatgaaattgttcgcgtagttttcctttcgcctcgtcgcgaatatccggcacccaaaaatagaccgatgccatcaccgcaatattaaaaacagcgatcaacaaaaaggtgtaacgccaactaaattcctgacttaaatacgttcccagtggaatgcccagcaaattggcgactgtcatcccggaaaccatccctgccacggcggcggtgactttgccgggtttgataatttttgataacacgatcgcgccgacgccaaaaaatgcaccatgcggaaagccggaaaccagccgaccaatggcgagcatcaggtaagacgaagagagcgtgaacatggcgttgccaatgacgcacaacgccaccagaaacaacaagatatgtttgagtgagtagcggctggaaaaaagcgcgattataggcgcaccgaccaccacccccagcgcataatacgagatcatatgcccggcggcaggaatcgaaattcctacgttatgcgccagctccgtgagcacgcccataatgccaaattcggccatccccaaaccaaacgtgcccagagccaaagataaaataacttttttcataccaccatcacaaccaccagaacggctaccaatcaccgtagccaataaagtgatagattgcaggataacgaccagcgaggccaagagataattcgcccctctgtattcattatcctgctgaatagttatttcattgcaaacgcactttccagtttgctgtagcccagtccattgatcttcttcactttgatctgcaccggaatacgctctttcatcgcctcaacgtggctaatcaccccgatggttttgccactggcattcagggcatccagcgcatcaagggcggtatccagcgtttcgctatccagtgtgccaaaaccttcatcaaggaacagcgagtcaatacgcgttttatggctgaccagatctgaaagcgccagtgccagcgccagactgacgaggaaactttcgccgccggaaagggtacgggtatcgcgtaccgcatcagcctgccaggtatcaacaacctcaacttccagcgcttcgctggctttgcgctgtaacagatagcgcccgtgcagccgggtaagttgctgattagcgagatggactaaattatccagcgtcagcccttgggcaaacttgcggaatttatcgccctctttggaacctattagcgaattcagatatccccagtcctcaacctgctgcgtcatttgagcaatttgctgcattaaggtttgttgttgctgacggttatctgcatcctgcttcagctgctggcgaatctcgccttgactcgtggtgttttcacgcaacttttggtgagtttgcgctaactcttgctgaatctgctccaccgtcacagtgagagataacccgccaggtcggtgttgctgatgctgtgtcagcgtttctgctgtctgagtgaccagcgtttgcgcctgacggcgctggttttccagattctgcttgagctgttccagctgcgttagtgtttgttcatccattagcgccgcaaggaacgcctgctgatcgtcaaagacgctcgcctgtagcgcggtgtcaaactgcgcctgggctttttgcagactttgcgccgccagaacatcctgttgctgtaacgtctgctgctggctgtgtaatgcgagacattgttcatgaacctgccgccagttttccagcaccacagtttcttcgctgtgcgggagttcatcactttgcggcaacgtttccagaatcggcgtcagttgctgaatacggttttgcagcgcggttaattcgttctggcgatgctgccagctctgcgcttcttgctgacgcgtcgccaaccagctctcttcttcatcttcctgtggcaatgtcagtgcataacccgccaatgccgttaagagctgctgctggcgttgttcaatttgctgttgatactggataatttgctgattatgcgcggcaatctgcccttgtaattcatgccgttggctgagtaaccgcagctggcgttcgtgctcatcttgtgcatctagccacggttgaatatcgtcctgtggctgcaaggtgatattgaggctggccgtgacggcttgccattgttgagtaagtgcttgctcatcttgtcggaggctttgcgcttcgttttcatcacgctgaagttgctttgttaaggcgtccagttgcccacgtagcgtcgcaccttcttcgccgagctttttcacttctttttccagcgttaatagccgggcctgattaacgcccggttccagcgcctgatacgcctcgaccgccgggtggctggtggaaccacaaagtggacaaggctgacccgcttgtaactgcgcgcgctgggcttccagcgttttaatgcgagtttcctgctcgcaaatggttttcacatcggcaagttgttgcgttttttctttataacgatggcgcatttcgttaagtgcggcattacgttgcgtctgttccagagtgacattctggatagcgacctgtaactgcgccagacgtttttgttggggaacaatctgcccatgcagtgcgaccaggcgctgacgcagtgggcgttgctcagcatgttgcgccagggcgctagcaacttcatcggcggttaacgtcaacgtgatcgccgcaagcgcattaagtttttgctcagcatgagttaactgttgctgccattgccgcagatgctcgcgatcgctggtttgttgggagaactgtgcacgccaacccgccagttcgttgttccactgacggaagcggtcgtgttcctgtaaccaggcattcaggctttgttgctgctgctgtaattctgctgactgcttcgccgcgtggtggcgaatgctcgcacgaagcgccattgtgctctgtaagcgagtatttacttcttcaatctgctggcgagtatgcgccagcgtcgtgctgtgttctgcgatgcgttcccagtgcggacgaagatttcgtgccggttgtgccagactgagcgccgccagttgaggttgcgctttttcttcttcggctaatgcctgttgcaaggcctgttgacggcggctggcttcttgctgcaattcgtccagacgcgttaaccagtttagcgattgttgttcttgctgctgcgcggtaattaactgtttttcttcgtcagtaagtacctgcaaactcgctgtcagcgattgcacttgttccggcgtgagcaacgcgacgctgctggcctgcgcttgcagcttctccagctctgtgcgggccgatttgtgctgctcaaaaaccatcgccgagatttgcccgtagatttcagtgccggttaactcctcgagcaattctgcgcgttctttgggtttggcattcaggaaggcagcaaattgcccctgcgaaagcagcatcgaacgggtgaagcgcccgtaatccagtccggttaacgtcgccgtcagttccagcttatctttcactttgtcggcgagaattttgccgtctgcacagcgcgccagctctacgcgtggcacctgcaaattaccgtccggctggttacgcgcccgattctggctccagaacgcgcgatacgcttcacctttgacttcaaactccacttccgccagacattcggcggtatcgcgggtcatgagatcattttgcgattgtgaaacgttagagaggcgcggggtttcgtgatacagcgccagacaaatggcatccagcagggtggttttccccgcaccggttgggccggtaatagcaaacagcccgttgctggcgaacggctcgcgggtgaaatcaatcttccattcgccttttaatgagttcaggtttttcaggcgcaggctgagaattttcatgcttcgtgttctccggcgaggctatgcaacgtcgtggcgaaaagatgctgcagacgttgctgctgtgattcatccagttcttccagtgccagacggcgattgaacacctcttcgacgctgagttcactgagggtttcacgctgttggctggctaacacacgctcgtgctgttcacgactccggcgtaccagcaatacttcgacaggcaatgattcggttaatgcctggattttgcgctgaatatcatgcagatactcatcagtagtgatttcgatatccagccagacaggcggctcctgtgatatatcgcgccactgttccagctgtgcggtaatcgacgccagatcgcctttcagcaccgccatgggttgcgttaccggtacgttcaggttttccacgctctctaatttgccgtttgaaaatgtcaccagatggacatatttactcttaccgcattcatcaaaactcagtggtatgggggaaccgcaatagcgaacatgttccatgccgccaataatctgcgcgcggtgaatatgcccgagcgcgatgtagtcggctggtggaaagttttgtgccggaaacgcgtccagcgtgccaatataaatgtcacgcacggcgtcacttttactggcacccacggtcgttaaatgtccagtggcgatgatgggcagaggctgatcgccgcgcagtttgcaggcatcggcataatgttgttgataataatcagtaatagccgccagcaaatgctgctgtttttcaataccgttaagccccgcctggctggtaataatgtcacgcgggcgtaaaaaaggaatgggacacagcactgcgcctggcgtcccgtcgcgacggggcaatatttgcggcgcatgtccggcgctggcgaccacggtagtattgaggaacgccatgatatcgcgcgattcattcagcgtggcgaccgagtcatggtttcctgccagtaccaccagatgacagcccgtttgctgtaaattgacaacaaaacggttgtataacgtgcgggcgtaactgggcggcgagccggtatcgaaaacatcaccggcaacaataatcgcatccacctgatgggcttgtgctgtctccagcagccagtcaagaaaagcctgatgttcagcttcgcggcttttactgtagaagttctggccgagatgccagtctgaggtgtgaaggatgcgcataacggttccctggcgaaaaagcatgggcgcgattatacccaaacagatgtgccatttgcttttttctgcgccacggaaatcaataacctgaaaggatgtgcgacgagcttttcataaatctgtcataaatctgacgcataatgacgtcgcattaatgatcgcaacctatttattacaacagggcaaatcatggcgagacgtattctggtcgtagaagatgaagctccaattcgcgaaatggtctgcttcgtgctcgaacaaaatggctttcagccggtcgaagcggaagattatgacagtgctgtgaatcaactgaatgaaccctggccggatttaattctcctcgactggatgttacctggcggctccggtatccagttcatcaaacacctcaagcgcgagtcgatgacccgggatattccagtggtgatgttgaccgccagaggggaagaagaagatcgcgtgcgcggccttgaaaccggtgcggatgactatatcaccaagccgttttctccgaaggagctggtggcgcgaattaaagcggtaatgcgccgtatatcgccgatggcggtggaagaggtgattgagatgcaggggctaagtctcgatccgacatctcaccgggtgatggcgggcgaagaaccgctggagatggggccaactgaatttaaactgctgcacttttttatgacgcatcccgagcgcgtgtacagtcgcgagcaactgttaaatcacgtatggggaaccaacgtgtatgtggaagatcgtacggtcgatgtccacattcgtcgcctgcgtaaagcactggagcccggcgggcatgaccgcatggtgcagaccgtgcgcggtacagggtatcgtttttcaacccgcttttaaggccttgctcatcggacgtagagcagggcttatgatttcttaactggagtatcttacgtgctggaacggctgtcgtggaaaaggctggtgctggagctgctactttgctgcctcccggctttcatcctgggtgcattttttggttacctgccctggtttttgctggcatcggtaacaggactgcttatctggcatttctggaatttattgcgcctttcatggtggctgtgggtggatcgtagtatgaccccgccaccggggcgtggtagctgggaaccgctactatacggcttacaccagatgcagctgcgaaataaaaaacgccgccgtgaactgggcaatctgattaaacgctttcgtagcggcgcggagtcgctgcccgacgcggtggtgctgaccacggaagagggcggtattttctggtgcaacggtctggcgcaacagattcttggcttgcgctggccggaagataacgggcagaacatccttaacttgctgcgttacccggagtttacgcaatatctgaaaacgcgtgatttctctcgcccgctcaatctggtgctcaataccgggcggcatctggagattcgcgtcatgccttatacccacaaacagttgctgatggtggcgcgagatgtcacgcaaatgcatcaactggaaggggcgcggcgtaacttttttgccaacgtgagccatgagttacgtacgccattgaccgtgttacagggttacctggagatgatggatgagcaaccgctggaaggcgcggtacgtgaaaaagcgttgcacaccatgcgcgagcagacccagcggatggaagggttggtgaagcaattgctgacgctgtcgaaaatagaagccgcaccgacgcatttgctcaatgaaaaggttgatgtgccgatgatgctgcgcgtcgttgagcgcgaggctcagactctgagtcagaaaaaacagacatttacctttgagatagataacggcctcaaggtgtcaggcaacgaagatcagctacgcagtgcgatttcgaacctggtctataacgccgtgaatcatacgccggaaggcacgcatatcaccgtacgctggcagcgagtgccgcacggtgccgaatttagtgttgaagataacggaccgggcattgcaccggagcatattccgcgcctgaccgagcgtttttatcgcgttgataaagcgcgttcccggcaaaccggtggtagcggattagggttagcgatcgtgaaacatgcggtgaatcatcacgaaagtcgcctgaatattgagagtacagtaggaaaaggtacacgtttcagttttgttatcccggaacgtttaattgccaaaaacagcgattaattcgcctttgtcatcttttattgccataagccagtcgatgctggcttattttctttgcagtcgaaatacgggcgttagattttacaacggttggtgattttttgttcgcatgattagccatgtctttttcattgaaatagtgttttatactggttggtgatttcttatcgctatatacctctggtttttagatcccttcttgctttaaaacgttataagcgtttaaattgcgcttcaggtgctgtcatactgactgcatttacgcggtaaatcgaaaaactattcttcgccgcgcttggttgggagtatttcccgctaaaattgtttaaatataccgctgtatcatccccagggattggcacaaaaatttaacgttacaacaccacatccacaggcagtatgatttatgacccatcaattaagatcgcgcgatatcatcgctctgggctttatgacatttgcgttgttcgtcggcgcaggtaacattattttccctccaatggtcggcttgcaggcaggcgaacacgtctggactgcggcattcggcttcctcattactgccgttggcctaccggtattaacggtagtggcgctggcaaaagttggcggcggtgttgacagtctcagcacgccaattggtaaagtcgctggcgtactgctggcaacagtttgttacctggcggtggggccgcttttcgctacgccgcgtacagctaccgtttcttttgaagtgggcattgcgccgctgacgggtgattccgcgctgccgctgtttatttacagcctggtctatttcgctatcgttattctggtttcgctctatccgggcaagctgctggataccgtgggcaacttccttgcgccgctgaaaattatcgcgctggtcatcctgtctgttgccgcaattatctggccggcgggttctatcagcacggcgactgaggcttatcaaaacgctgcgttttctaacggcttcgtcaacggctatctgaccatggatacgctgggcgcaatggtgtttggtatcgttattgttaacgcggcgcgttctcgtggcgttaccgaagcgcgtctgctgacccgttataccgtctgggctggcctgatggcgggtgttggtctgactctgctgtacctggcgctgttccgtctgggttcagacagcgcgtcgctggtcgatcagtctgcaaacggtgcggcgatcctgcatgcttacgttcagcatacctttggcggcggcggtagcttcctgctggcggcgttaatcttcatcgcctgtctggtcacggcggttggcctgacctgtgcttgtgcagaattcttcgcccagtacgtaccgctctcttatcgtacgctggtgtttatcctcggcggcttctcgatggtggtgtctaacctcggcttgagccagctgattcagatctctgtaccggtgctgaccgccatttatccgccgtgtatcgcactggttgtattaagttttacacgctcatggtggcataattcgtcccgcgtgattgctccgccgatgtttatcagcctgctttttggtattctcgacgggatcaaggcatctgcattcagcgatatcttaccgtcctgggcgcagcgtttaccgctggccgaacaaggtctggcgtggttaatgccaacagtggtgatggtggttctggccattatctgggatcgtgcggcaggtcgtcaggtgacctccagcgctcactaaatcactgaacatttgttttaaccacggggctgcgatgccccgtggttttttattgtgttgatgggttaggaattgatggaaagtaagaacaagctaaagcgtgggctaagtacccgacacatacgctttatggcactgggttcagcaattggcactgggctgttttacggttcggcagatgccatcaaaatggccggtccaagcgtgttgttggcctatattatcggtggtatcgcggcgtatatcattatgcgtgcgctgggggaaatgtcggtacataacccggcagccagctctttctcgcgttatgcgcaggaaaacctcggcccgctggcaggttacattaccggctggacctactgctttgaaatccttattgtcgccatcgccgatgtgaccgcttttggtatctatatgggtgtctggttcccgacggtgccgcactggatttgggtactgagtgtggtgctgatcatttgcgccgtaaacctgatgagcgtgaaggtattcggtgagctggagttctggttctcgttctttaaagtcgccactatcatcatcatgattgtcgccggtttcggcatcatcatctgggggattggcaacggcgggcaaccgaccggtattcataacctgtggagcaacggcggcttcttcagtaacggctggcttggtatggtgatgtcgttgcaaatggtgatgtttgcttacggtgggatcgaaattatcgggattaccgccggtgaagcgaaagatcctgagaaatcgattccgcgtgcgattaactccgtgccgatgcgtattctggtgttctacgtcggtacgttgttcgtcattatgtctatctacccgtggaatcaggttggcactgccggtagcccgtttgtgctgacgttccagcatatgggcattacctttgccgccagcattcttaactttgttgtgctgaccgcttcgctgtcggcaattaacagtgacgtatttggtgtaggccgtatgctccacggtatggcagagcagggcagcgcgccaaaaattttcagcaaaacctcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtgtgggtgtggattatgatcctgctgtcgcaaatcgccttccgtcgccgtttgccgccagaagaagttaaggcgctgaaatttaaagtgccgggtggggtcgcaaccaccatcggcggtttgattttcctgctctttattatcgggttgattggttatcaccctgatacgcgtatctcgctgtatgttggtttcgcgtggattgttgtgctgttgattggctggatgtttaagcgccgccacgatcgtcagctggctgaaaaccagtaatccttgcgttctgtaagccggttcaggaggaaatcctgatccggctattccgaaagttatccgcccccgtcctcctcccccaaatatccttcagatgatgagtgatcctgcattaggctatggcaaggtgatcagatttttatcacaggggaattatgatgttaaatgcatggcatctgccggtgcccccatttgttaaacaaagcaaagatcaactgctcattacactgtggctgacgagcgaagacccaccgcagcgcattatgctgcgtacagaacacgataacgaagaaatgtcagtaccgatgcataagcagcgcagtcagccgcagcctggcgtcaccgcatggcgggcggcgatcgatctctccagcggacaacctcggcggcgttatagtttcaaattgctgtggcacgatcgccagcgttggtttacaccgcaaggcttcagccgaatgccgccagcacgactggagcagtttgccattgatgtaccggatatcggcccacaatgggctgcggatcagattttttatcagatcttccctgatcgtttcgcccgtaatcttcctcgtgaagctgaacaggatcatgtctattaccatcacgcagccggacaagagatcatattgcgtgactgggatgaaccggtcacggcgcaggctggcggatcaacgttctatggcggcgatctggacgggataagtgaaaaactgccgtatctgaaaaaacttggcgtgacggcgctgtatctcaatccggtgtttaaagctcccagcgtgcataaatacgataccgaggattatcgccatgtcgatccgcagtttggcggtgatggggcgttgctgcgtttgcgacacaatacgcagcagctgggaatacgactggtgctggacggcgtgtttaaccacagtggcgattcccatgcctggtttgacaggcacaatcgtggcacggggggagcttgtcacaaccccgaatcaccctggcgtgactggtactcgtttagtgatgatggcacggcgctcgactggctgggctatgccagcttgccgaagctggattatcagtcggaaagtctggtgaatgaaatttatcgcggggaagacagtattgtccgccactggctgcaagcgccgtggaatatggatggctggcggctggatgtggtgcatatgctgggggaagcgggtggggcgcgcaataatttgcagcacgttgccgggatcaccgaagcggcgaaagaaacccagccggatgcgtatattgtcggcgaacattttggcgatgcacggcaatggttacaggccgatgtggaagatgccgccatgaactatcgcggcttcacattcccgttgtggggatttcttgccaacaccgatatctcttacgatccgcagcaaattgacgcccaaacctgtatggcctggatggataattaccgcgcagggctttctcatcaacaacaattacgtatgtttaatcagctcgacagccacgatactgcgcgatttaaaacgctgctcggtcgggatgttgcgcgcctgcccctggcggtggtctggctgttcacctggcctggtgtaccgtgcatttattacggtgatgaagtgggactggatggcaaaaacgatccgttttgccgtaagccgttcccctggcaggtggaaaagcaggattcggcgttattcgcgctgtaccagcgaatgattgcgctgcgtaagaaaagtcaggcgttgcgtcgtggcggctgtcaggtgctgtatgcggaagataacgtggtggtatttgtccgcgtgctgaatcagcagcgtgtactggtggcaatcaaccgtggcgaagcctgtgaagtggtgctacccgcgtcaccgttgcttaatgtcgcgcaatggcaacgcaaagaaggtcacgggcaactgacggacgggattctggctttgcctgccatttcggctacggtgtggatgaattaacgtcttataacgccttgcgtgacgcctgcgccatcatccgcggataaaactgccagaagcgggtttcgagagcatcgtaatgggcgtctaaatcgtaccaggagtcacgcagggcatccagacgtgggcgacggcttgccatgccgtttaacacgttctggatgaaatccatatcgcgatagcgcaccagccactgctctgaccacaagtaattgttcagattgataaaacgtggcggtgagtccggcaaaatcgtcatcacttgctcgcgggcataacagacaaattcctgtagcggaaagtccggcgacagctgcgaccagtggcgggaaagaaagtgatcccacatgacatccagggtaataggcgcaacgcggcgcgtttcactacgaaaccattcccgtgcttcgcggacttccggcagattgtcggttagtacatcaatgcgccgatgcatatgaatgccagccacgacgtcgggcggaaaactttcttcaggatttccgcgtacgaaatcagccagcaaattgccggaaagcgagctttccgcgagatgggctaaatgcaggtgagctaaaaaattcatcgattatattctatccaaaggggggtaaaggttgcagggagagcgccccggcactagactacccgcctcttattttagtctgagtcagtgtcatgcgcgttaccgatttctcctttgaattgcccgaatccctgattgcccactatcccatgcctgaacgcagtagctgtcgtttactgtcgctggacgggccgacgggcgcgctgacgcacggtactttcaccgatttactcgataagctcaaccccggcgatcttctggtttttaataatacccgtgtgatcccggcgcgcctgtttgggcgtaaagccagcggcggcaagattgaagtgctggttgagcggatgctcgacgacaaacgcatttttgcgcatattcgcgcctcgaaagcgccaaaacctggcgcagaactgttgctgggcgatgacgaaagtattaacgcaacaatgaccgcgcgccacggcgcactgtttgaagtcgaatttaatgatcaacgttcggtgctggatattctcaacagcatcggccatatgccgctgccgccgtacatcgaccgtccggacgaagatgcagaccgcgaactttatcaaacggtttatagcgaaaaaccaggcgcggtagcagcaccgaccgccggactgcactttgacgaacctttgctggaaaaattacgcgccaaaggcgtggagatggcgtttgtgacgttgcacgttggtgcgggcaccttccagccggtgcgcgtcgacaccattgaagatcacatcatgcactcggaatacgctgaagtgccgcaggatgtggtagacgcggtactggcggcgaaagcgcgcggtaaccgggtgattgcggttggtaccacctcagtacgttcgctggaaagtgcggctcaggcagcgaaaaacgatctcattgaaccgttctttgacgatacccaaatctttatctatccgggcttccagtacaaagtggtcgatgcgctggtgacgaacttccaccttccggaatcgacgctgattatgctggtttcggcatttgctggttatcaacacaccatgaatgcctataaagcggcggtagaagagaaatatcgcttttttagttacggtgatgcgatgtttatcacgtacaatccgcaggcaattaatgagcgcgttggggagtaattccgcggcgctggtttaaacgttggactgtttttctgacgtagtggagaaaaaatgaaatttgaactggacaccaccgacggtcgcgcacgccgtggccgcctggtctttgatcgtggcgtagtggaaacgccttgttttatgcctgttggcacttacggcaccgtaaaagggatgacgccggaagaagttgaagccactggcgcgcaaattatcctcggcaacaccttccacctgtggctgcgcccgggccaggaaatcatgaaactgcacggcgatctgcacgattttatgcagtggaaaggaccaatccttaccgactccggcggcttccaggtcttcagccttggtgatattcgtaaaatcaccgaacagggcgttcacttccgcaacccgatcaacggcgacccgattttcctcgacccggaaaagtcgatggagattcagtacgatcttggttcggatatcgtcatgatctttgatgagtgtacgccgtatcctgctgactgggattacgcaaaacgctccatggagatgtctctgcgttgggcgaagcgtagccgtgagcgttttgacagtctcggaaacaaaaatgcgctgtttggtatcattcagggcagtgtttacgaagatttacgtgatatttctgttaaaggtctggtagatatcggttttgatggctacgctgtcggcggtctggctgtgggtgagccgaaagcagatatgcaccgcattctggagcatgtatgcccgcaaattccggcagacaaaccgcgttacctgatgggcgttggtaaaccagaagacctggttgagggcgtacgtcgcggtatcgatatgtttgactgcgtaatgccaacccgcaacgcccgaaatggtcatttgttcgtaaccgatggcgtggtgaaaatccgcaatgcgaagtataagagcgatactggcccactcgatcctgagtgtgattgctacacctgtcgcaattattcacgcgcttacttgcatcatctcgaccgttgcaacgaaatattaggcgcgcgactcaacaccattcataaccttcgttactaccagcgtttgatggcgggtttacgcaaggctattgaagagggtaaattagagagcttcgtaactgatttttaccagcgtcaggggcgagaagtaccacctttgaacgttgattaatattaataatgagggaaatttaatgagcttttttatttctgatgcggtagcggcaacgggtgcaccggcgcaaggtagcccgatgtctttgattttgatgctggtggtattcggtctgattttctatttcatgatcctgcgtccacagcagaagcgcaccaaagaacacaaaaagctgatggactccatcgctaaaggtgatgaagtgctgacgaacggtggcctggtcggtcgcgtaaccaaagtagcggaaaacggctacattgctatcgcactgaatgacaccactgaagtagttattaaacgtgacttcgtagctgccgttctgccgaaaggcaccatgaaggcgctgtaattaaaatttttccctaagggaattgccgtgttaaaccgttatcctttgtggaagtacgtcatgctgatcgtggtgattgtcatcggtctgctgtatgcgcttcccaacctgtttggtgaggatccggctgttcagatcactggtgcgcgcggagtcgccgccagtgagcaaacgctgatccaggtccagaaaacgttacaagaagaaaaaataactgctaagtctgtggcactggaagagggcgctattcttgcgcgcttcgactccactgacacccagctgcgcgctcgtgaagcattaatgggcgttatgggtgacaaatacgtcgtggcgcttaaccttgccccggcaacgccgcgctggctggcagctattcatgctgagccgatgaagctcggccttgacctgcgtggcggcgttcacttcctgatggaagtggatatggacaccgcgcttggcaaactccaggaacaaaatatcgatagcctgcgcagcgacctgcgtgaaaagggcatcccgtataccaccgttcgtaaagaaaacaactacggcctgagcatcactttccgcgatgctaaagctcgtgatgaagccattgcgtatctgagcaagcgccatccggacctggtgattagcagccagggcagcaaccagctgcgtgcggtaatgagcgatgctcgtctgagtgaagcgcgtgaatatgcggtgcagcagaacatcaatatcctgcgtaaccgtgtaaaccaacttggcgtggcggagccggtggttcagcgtcagggtgctgaccgtatcgttgttgaactgccaggtattcaggacactgcgcgtgcgaaagagattctgggtgcgacggcaacgctggaattccgtctggtaaacaccaacgttgatcaggccgctgcggcatccggtcgcgtaccgggcgactctgaagtgaaacagacccgcgaaggtcagccggttgtgctgtacaaacgcgtaattctgaccggtgaccatatcaccgactccacttccagccaggacgaatacaaccagccccaggttaacatctcgctcgatagcgcgggtggtaacatcatgtctaacttcaccaaggacaacatcggcaaaccgatggcaaccctgtttgtggagtacaaagacagcggtaagaaagatgcaaacggtcgtgcggttctggtgaaacaggaagaggtgattaacatcgccaacatccagtctcgtctgggtaacagcttccgtatcaccggcatcaacaacccgaacgaagcgcgtcagctgtcgctgctgctgcgtgccggtgcgttgattgcaccgattcagattgttgaagaacgtaccattggtccgaccctgggtatgcagaacattgaacaggggctggaggcttgccttgccggtctgctggtttctattctgttcatgattatcttctataagaagtttggtctgattgcgaccagtgctctgattgccaacttgatcttgattgtcggtattatgtcgctgttgccaggcgcaacgctgagtatgccaggtatcgcgggtatcgtcttaacccttgcggtagcggtcgatgcgaacgtactgatcaacgaacgtattaaagaagagttgagcaacggacgtactgttcaacaggcaattgatgaaggttatcgtggcgcattcagttccatcttcgatgcgaacatcaccacgctgattaaagtcatcatcctgtatgcagtgggtaccggggcaattaaagggttcgcgattactaccggtatcggtgtggcgacgtcgatgtttaccgcgattgtcggtacgcgtgccatcgtaaacctgctatatggcggcaagcgcgtcaagaagctgtcaatctgaggagtgcgatgtggcacaggaatatactgttgaacaactaaaccacggccgtaaagtctatgactttatgcgctgggactactgggctttcggcatctctggtctgctgttaatcgccgctatcgttattatgggcgtgcgcggctttaactgggggctggattttaccggtggtacggttattgaaattacgctcgaaaaaccagctgaaattgacgtaatgcgtgatgcattgcaaaaagccggttttgaagagccgatgctgcaaaactttggtagcagccacgacatcatggtccgtatgccgcctgctgaaggcgaaaccggcggtcaggtgttgggcagccaggttctgaaggtgattaacgaatccaccaatcagaatgcggcagtgaagcgtattgagttcgtcggtccgagcgtgggggcagaccttgcgcaaaccggtgcgatggcgttgatggcggcgctgctgtctatcctcgtgtacgtaggtttccgctttgagtggcgactggcggcaggggttgttattgcgctggcgcacgacgttatcattacgctgggtattttgtcgttattccatatcgagattgacctgaccattgtggcatcattgatgtcggttatcggttactcgcttaacgacagtatcgtggtatcggaccgtattcgtgaaaacttccgcaagatccgtcgcggtacgccttacgaaatctttaacgtgtccttgacccagacgctgcaccgtaccttgatcacatccggtactaccttgatggttatcctgatgctgtacctcttcggtggtccggtactggaaggcttctcgctgaccatgcttatcggtgtttccatcggtactgcatcttccatctatgtggcatctgcgctggctctgaaactgggtatgaagcgcgaacacatgttgcagcagaaagtggaaaaagaaggggcggatcagccgtcaattctgccttaatcaagtttcagctgatgttgaaaatcccggtcagaagatcgggattttttttgatgtaaggtgattgcgaaaatccccgcatcttgggaaactgcgcgtaaccctacatttcatccaggtaactttttcatggctatcatcccaaaaaactatgcgcggttagaaagcggctatcgcgaaaaagcattaaaaatctatccgtgggtctgcggtcgctgttcccgcgagtttgtttattccaacctgcgtgaacttaccgttcaccacattgatcacgaccatactaataacccggaagatggcagtaactgggaattactttgtctctattgccacgatcatgagcattcgaaatacaccgaagcggatcagtatggtacgaccgttatcgcaggggaagatgcgcagaaagatgtcggtgaagcgaagtacaacccattcgctgatttgaaagcgatgatgaacaagaagaagtgataaaaaatgccggatatgaaatccggcattctcacaattagaagttgtaacctactaccagataaccaccccagccggtagagcgaacgttgaagttgccgttgccgaagttcagttctgcatcgtcattccactgaccaccgttatgccagtaacgggcaacgacagagtagtgccagtgatcgtaattcagcgccagaatatggctggacgcaatagagttattggtacgtgttttaataccgttgttcgcataaccgctgtcatcgcccaggtcggaaccccagtcgaagttggtgaagccgatgtagctcagctggccgccccacagatcggtaatcggcacaaagtacttcactttgaaacggtaaccgtcccactcgttttcgttcgctgcgccgtagttctgccactggtatttcgcatagacgttcatggacaggctcatcggcagaccagtatcgatgtcggtacccagacccatgtaccaggtgctctggcggccatctttattacgacccatgtcgtaaatgtagttgttcgcgaagtaccactctttgaacggaccaaagctaaggtcagtattggtcagcttgtcaatggagaaacgcggttcgatttccataaacagcggagaaccgtggttccagataccttttgcatcggagttaccgccgaagaataccggcgcatccgcataaccatagaagtcgaaccagtcttttttagcgaatgcttcgtactcaaggtaggtatcgttgcggagctgcggtccgaaacgggtgtgatagcttccgacaacgttaacgctctggtgccaccagtcggaaagatactgcggtttgtcgttttcagctgcattgacagtaaaagacgaagagagcgccagtaccgcaccggctgccagtaatgtttttttcatatgtatgccactgtttgaaaatcccttgcgggagtgaaaaaggcgcaaattgcgtttctaaatatttcgtatacagaggagcctattataaaaatcattgctcacaaaaatatgtttcgtttcacagttctatcatttacgtaatcgattgcgttcacgtttacacacattcgggcggggattgtactgactttcacccttgttgcaaacttttactatcaatccaggtgatgtaagcggagtaacaaaatgacggagaaagatgttgcgggacgcacaatatcgccccgcaatacgtttactgcataacaggttgaatgtcgtggatacgtacaaagcctaactgatccacagaaataccctttaactgtaacggaatatcaacatcgctgggggcgaggacgctggcaggtgcgttaatcaattgattctgcacattgatttcctgaaagttgtctattgttccctgaatttgcccatattcaacggttccgctgaatgcgggtaaagggtcattggattcgccctgaatacgtagcgtcagggtggtgccatctgtatcaggcgtaatattcaccagcgacatacgtaaagtaccgatctggctttccagtcttgctggtgtttttgctccaggcagaaggtaaaccccactgctggattttgcattcagcctgttttgctgagtgattttgaccgtttctttattgagctgcgtcatctcctggttcagcgtgctgacgctgtgtttcatctgtcgcacttcactttgctgcacacaggcgctaaggctgaacaggcttcccagcaggagcagtcgaaaaacgttagtattcataggtcgtccctttctcgtcgcaattagcctaatggtagagggtaaaagcagtgaaagcatcgatcctttatctcaaaagcgttgcgcctttgttgtatcgtcagttcagggtaaaatagatttctgttaaccacctggtcaggacgccgtatgcattgcccattctgtttcgccgtggacactaaggtaattgactctcgtctcgtgggcgagggttcatccgtacgccgccgtcggcagtgtctggtgtgtaatgaacgtttcaccacctttgaagtggcggagctggttatgccgcgtgttgtaaaaagcaacgacgtgcgtgaaccgtttaatgaagagaaattacgtagcggaatgctgcgggcgctggaaaaacgtccggtgagttccgatgacgtcgaaatggcaatcaatcatataaaatcgcagctgcgcgccaccggtgagcgcgaagtgccgagcaagatgattggcaatctggtgatggagcaattgaaaaagctcgataaagtcgcctatatccgttttgcctctgtctaccgcagtttcgaagatatcaaagaatttggcgaagagatcgcgcgcctggaggactaagccgtgcaggacgagtattacatggcgcgggcgctaaagctggcgcaacgaggacgttttaccacgcatcccaacccgaatgtcgggtgcgtcattgtcaaagatggcgaaattgtcggtgaaggttaccatcaacgcgcgggtgaaccgcatgccgaggtacacgcgttgcgcatggccggcgaaaaagccaaaggcgcaacggcgtatgtcacactcgaaccctgtagccatcatggtcgtacgccaccgtgttgtgatgcattaattgctgcgggcgtggcgcgcgtggttgctgcaatgcaagaccccaatccgcaggtcgctggacgtggactttaccgtctgcaacaggctggcattgacgtcagccacgggctgatgatgagtgaagctgagcaattgaataaaggctttctcaaacggatgcgcaccggctttccttatattcagttaaaacttggcgcatcgcttgatggtcgcacggcgatggcgagtggcgaaagccagtggatcacttcacctcaggcgaggcgcgacgtacaacgactgcgcgcgcaaagtcatgccattttaaccagcagcgccacggtgctggcggatgatccagccttaacagtgcgttggtctgaactggatgaacaaactcaggggctctacccgcaacaaaatctccgccagccggtacgtattgtgattgatagccaaaatcgcgtgacgccggaacatcgcattgtgcagcagcccggcgaaacctggttcgcgcgtacgcaggaagattctcgtgagtggccggaaacggtgcgtaccttgctgattccagagcataaaggtcacctggatctggttgtactaatgatgcaactgggtaaacagcagattaacagcatctgggtggaagcggggccaacgctcgctggcgcattgctacaggcgggtttagtcgatgagctgattgtctatatcgcacctaaactattaggcaacgacgcccgtggattatgcacgctgccagggcttgagaaattagccgacgctccccaatttaaattcaaagagatacgtcatgtaggcccggatgtttgcctgcatttagtgggggcatgatctcccggctcgaaagggaagcagcgcacgaaatattatgctaaaatccgcccccctgcggggccatactcgaacccgaaggaagaaaatgaacattattgaagctaacgttgctaccccggacgctcgcgtcgccatcaccatcgcgcgtttcaacaactttatcaatgacagcctgctggaaggtgcaattgacgcactgaaacgtatcggtcaggtaaaagatgaaaacattaccgttgtttgggtgccaggtgcctatgagctgccgctggcggcgggtgcactggctaaaaccggtaaatacgacgcggtgattgcgctgggtacggttattcgtggtggcactgcccactttgaatatgtcgctggtggtgcaagcaacggcctggcgcatgttgcccaggacagcgaaattccggttgcttttggtgttctgaccactgaaagcattgaacaagcgatcgaacgtgctggcaccaaagctggcaacaaaggtgcagaagctgcactgaccgcgcttgaaatgattaatgtattgaaagccatcaaggcctgaaattagtaaggggaaatccgtgaaacctgctgctcgtcgccgcgctcgtgagtgtgccgtccaggcgctctactcctggcagttgtcccagaacgacatcgctgatgttgaataccagttcctggctgaacaggatgtaaaagacgttgacgtcctgtacttccgtgagctgctggccggggtggcgactaacaccgcatacctcgacggactgatgaagccgtacctgtcccgtctgctggaagaactgggccaggtagaaaaagcagtactgcgcattgcgctgtacgagctgtctaaacgtagcgatgtgccatacaaagtggccattaacgaagcgatcgaactggcgaaatcgttcggcgcagaagacagccataagttcgtcaacggcgtactcgataaagcagcacctgtgattcgccctaacaaaaagtaatatccaggccggtagattcacggaagaccgttccatgatcgccggccttttcttttttacctgctgaggcataacgtatggcatgtggcgagttctccctgattgcccgttattttgaccgtgtaagaagttctcgtcttgatgtcgaactgggcatcggcgacgattgcgctcttctcaatatccccgagaaacagaccctggcgatcagcactgatacgctggtggcgggcaaccacttcctccctgatatcgatcctgctgatctggcttataaagcactggcggtgaacctaagcgatctggcagcgatgggggccgatccagcctggctgacgctggcattaaccttaccggacgttgacgaagcgtggcttgagtccttcagcgacagtttgtttgatcttctcaattattacgatatgcaactcattggcggcgataccacgcgtgggccattatcaatgacgttgggtatccacggttttgttccgatgggacgagccttaacgcgctctggggcgaaaccgggtgactggatctatgtgaccggtacaccgggcgatagcgccgccggactggcgattttgcaaaaccgtttgcaggttgccgatgctaaagatgcggactacttgatcaaacgtcatctccgtccatctccgcgtattttacagggacaggcactgcgcgatctggcaaattcagctatcgatctctctgacggtctgatttccgatctcgggcatatcgtgaaagccagcgactgcggcgcacgtattgacctggcattgctgccgttttctgatgcgctttctcgccatgttgaaccggaacaggcgctgcgctgggcgctctctggcggtgaagattacgagttgtgtttcactgtgccggaactgaaccgtggcgcgctggatgtggctctcggacacctgggcgtaccgtttacctgtatcgggcaaatgaccgccgatatcgaagggctttgttttattcgtgacggcgaacctgtcacgttagactggaaaggatatgaccattttgccacgccataaagatgtcgcgaaaagtcgcctgaaaatgagtaatccgtggcatctgcttgctgtcggattcggaagtggattaagcccgatcgttcctggcacgatggggtcgctggcggcgattcccttctggtatctgatgacttttttgccctggcagctctattcgctggtggtaatgctggggatctgtatcggcgtctatctttgtcatcaaacggcgaaagacatgggcgtgcacgatcacggcagtattgtctgggacgaatttattggtatgtggattacgctcatggcgctgccgaccaatgactggcagtgggttaccgccggatttgtgattttccgtattctggatatgtggaagccgtggccgatccgctggtttgatcacaatgtacatggcggcatggggatcatgattgacgatattgtcgccggggtgatctccgctggcatcctgtattttatcggtcatcactggccgctgggtattctgtcgtagttgtgcaccgatgcctgatgtgacgcttgtcacgtctcatcaggcctgcatacctatttaaatcctacgaccggatgcggtttatacggcgtttccagctcggcgatctgttccggcttcaaggtgatatccaccgcgtttagcagttcatcaagctgttcctcccgagaagttccgataatcggtgcggcaatgcccggtttactcaacaaccaggccagcgcaacttgtgctcgcgttgcaccaagttcttcactgacgcccgttaagcgttctgcaatttgtgcgtcattttcattgctttcttggtagagatttttccccacttcatccgacaccagccgtgcggtggtttctccccaaggacgcgtcagacggccccgcgccagcggactccatggaatcaccgccacgccttcctgataacacagcggcagcatctcgcgctcttcttcacgataaatcagattgtagtgatcctgcatactgacaaactgcgcccagccgtgctgtttttgtagttccagtgcctgagcaaactgcgaagcgtgcatggatgacgcgccgatataacgcgctttcccggcttttaccacgtcgttcagggcttccagcgtctcttcgatcggcgtgttgtaatcccagcgatgaatttgcaggatatcgacataatccatgccgagacggagcaggctgtcgtcgatagagcgcaaaatttgtgcacgggataatccttccggtaaatcaccaacgcgatggaacactttggtcgcaacgaccacgtcttcacgacgggcgaaatcccgcagtgcgcgaccgacgatctcttcgctgctgccatcggaatagctattggcggtatcaaagaaatttatgccgccttccagtgcgcgtttaatgatgggacggctgctctcttccggcagtgtccatgcgtgattaccgcgatctggctcgccaaaggtcatacagccgaggcaaagtcgggaaacacgaaggtcggtttttcctaaggggttgtattgcatgctgccactcctgccatgaataatttcttaagcatagcaggagtagagtagggattatgccagccaggctttgattttggcttccataccggtggcatcgaggccgagttcggcgcgcatttcttcctgagttccttgtggaataaagaagtccggcagaccaatgttcagcacgggtactggtttacgatgggccatcagcacttcgttcacgccgctgcctgcaccacccataatggcgttttcttctacggtaaccagcgcttcatggctggcggccatttccagaattaacgcttcatcaagcggtttcacgaaacgcatatcgaccagcgtagcgttcagcgattcagcgactttcgccgcttctggcatcagcgtaccaaagttaaggatcgccagtttctcaccacgacgcttcacaatgcctttgccaattggcagtttttccagtggcgtcagttccacgccaactgcgttgccgcgcgggtagcgcaccgcggacgggccatcgttatagtgatagccggtatagagcatctggcgacattcgttttcatcgctcggggtcataatgaccatttccggtatgcagcgcaggtaagagagatcaaaagcgccctggtgggtttgaccgtcagcaccaacaatgcccgcacggtcgatggcgaacaggaccggaagcttttgaatcgccacgtcatgcagcacctgatcataggcgcgttgcaggaaggtggagtagatcgcaacaatgggtttgtagcctccaatcgccagacccgcagcaaaggtcactgcgtgttgctcggcaattgccacgtcgaagtagcgatccgggaatttacgtgaaaactcgaccatgccggaaccttcacgcatcgccggagtaatcgccatcagcttgttatctttcgctgcggtttcgcacaaccagtcgccaaagatttttgaatagcttggcaaaccgccgctacttttcggcagacaaccgctggagggatcaaatttaggcacggcgtggaaggtgattgggtctttttctgccggttcataaccacgaccttttttggtcatgatatgcaggaactgcgggcctttcaggtcgcgcatgttcttaagcgtggtgataagccccagcacatcgtgaccgtccaccgggccgatgtagttaaagcccagctcttcaaacaacgtgccaggcactaccatgcctttaatatgttcttcggtacgtttgagcagctctttaatgggtggcacgccagagaaaactttttttccgccttcgcgcagtgaagagtaaagcttaccggaaagcagctgcgccagatggttgttgagcgcgccaacattttcggaaatcgacatttcattgtcgttgagaaccaccagcatatcaggacggatatcgcccgcgtgattcatcgcttcaaacgccatgccagcagtaatcgcgccatcgccaatgacacagacggtgcggcgatttttgccttctttctcggcagcaactgcgatcccaattccggcactgatggaggttgatgaatgcccgacgcttaatacgtcatattcgctttcgccgcgccacgggaacgggtgcaggccacctttctgacggatggtgccgattttgtcgcggcgcccggtcaaaattttatgcggataagcctgatgccccacatcccagattaactggtcaaacggggtattgtagacatagtgcagcgccacggtcagttcgaccgtgcccagcccggaggcgaagtgcccgctggaacggctcacgctgtcgagtaaatagcggcgcagttcgtcgcagagtttcggtaaactctctttcggcaacagtcgtaactcctgggtggagtcgaccagtgccagggtcgggtatttggcaatatcaaaactcatcaggggcctattaatacttattgtttatttattacgctggatgatgtagtccgctagcgcttccagtgccgaggtatcgagtgactgttcagtcagttgtttcagcgactgacgggcatcgtcgatcagatcctgggctttcttccgggcttgctcaagacccagaagtgcagggtaggtacttttaccaagttgctggtcggcaccctggcgttttcccaacgttgcagtatctcccaccacatccaggatgtcatcctgaacctggaaggcaaggccgatgctctctgcgtacttgtcgagtactggcagagcacgacgtcctttatctccggcgcttaatgcaccaaggcgaacggcggcgcgaatcaatgcgccggttttatgacgatgaatacgctcaagcgcgtccagaggtacgtgtttgccttcagcgtctaaatctaatgcctgaccaccgcacattccggcaataccgctggcgctcgccagctcagaaatcatcgaaattctgtcgcgatctgacacttccggcatatcggcatcgcttagaatcgagaacgccagcgtttgtaaagcgtcaccagcgagaatcgcgtttgcttcgccaaacttcacatggcaggtcggcaaaccgcgacgcagatcgtcatcatccatcgccggtaaatcatcatgaattaatgagtaagcgtggatacactctacggcggcagcgggtgcgtccagtgtgtttgtgctaacgccgaacatatgaccagtggcataaaccaggaaaggtcgcaggcgcttaccacctaataatgcgccatactgcatggtttcgaccacgggagtgttctgaaagggcagtggggcgataaaacggctcagcgcctggttggcctgcttaacgcaggcttcgagttgctgcggaaagtccattactcattgtccggtgtaaaaggggttagagaggcgtcttcattgtcagacagcagaatttgtacgcgctgttcggcttgttgtaatttggcctgcccctgacgtgccagctgcacgccgcgttcgaattcgttcagcgcctcttccagcggcaggtcgccactttccagacgggttacaatctgttccagctcgctcagcgccttttcaaagctggcgggagcctcatttttcttcggcataatgaatgtctgactctcaatatttttcgccccgtcatggtaacggactcagggcaaatagcaaataacgcgcaatggtaaggtgatgtgcgcagcaaagcgatgttagtggtatacttccgcgcctggatgcagccgcaggtgtgggctgctgtatttttccctatacaagtcgcttaaggcttgccaacgaaccattgccgccatgaagtttatcattaaattgttcccggaaatcaccatcaaaagccaatctgtgcgcttgcgctttataaaaatccttaccgggaacattcgtaacgttttaaagcactatgatgagacgctcgctgtcgtccgccactgggataacatcgaagttcgcgcaaaagatgaaaaccagcgtctggctattcgcgacgccctgacccgtattccgggtatccaccatattctcgaagtcgaagacgtgccgtttaccgacatgcacgatattttcgagaaagcgttggttcaatatcgcgatcaactggaaggcaaaaccttctgcgtacgcgtgaagcgccgcggcaaacatgattttagctcgattgatgtggaacgttacgtcggcggcggtttaaatcagcatattgaatccgcgcgcgtgaagctgaccaatccggaagtgactgtccatctggaagtggaagacgatcgtctgctgctgattaaaggccgctacgaaggtattggcggtttcccgatcggcacccaggaagatgtgttgtcgctcatttccggtggtttcgactccggtgtttccagttatatgttgatgcgtcgcggctgccgcgtgcattactgcttctttaacctcggcggcgcggcgcatgaaattggcgtacgtcaggtggcgcattatctgtggaaccgctttggcagctcccaccgcgtgcgttttgtcgctattaatttcgaaccggtcgtcggggaaattctcgagaaaatcgacgacggtcagatgggcgttatcctcaaacgtatgatggtgcgtgccgcgtccaaagtggcagaacgttacggcgtacaggcgctggttaccggtgaagcgctcggccaggtgtccagccagacgctgaccaacctgcgcctgattgataacgtctccgatacgctgatcctgcgtccgctgatctcttacgacaaagagcacatcatcaacctggctcgccagattggcaccgaagactttgcccgcacgatgccggaatattgcggcgtgatttccaaaagcccgacggtgaaagcggttaaatcgaagattgaagcggaagaagagaagttcgacttcagcattctcgataaagtggtggaggaagcgaataacgttgatatccgcgaaatcgcccagcagaccgagcaggaagtggtggaagtggaaaccgttaatggcttcggcccgaacgacgtgatcctcgatatccgttctatcgatgaacaggaagataagccactgaaagtcgaagggattgatgtggtttctctgccgttctataaactgagcaccaaatttggcgatctcgaccagagcaaaacctggctgttgtggtgtgagcgcggggtgatgagccgcctgcaggcgctctatctgcgcgagcagggctttaacaatgtgaaggtgtatcgcccgtaatatgtggttgtaacgtcgcatctggtcagatgcgacgtttaccgcatccgacactactcgtaataattataaatccctgccgccatcaccagttgtgatgccacttcatgggctttctcgcgcccaaccagcaggtcgataattttcagaccaaagtcgatagctgtacctggcccctggctggtcagcaattttacccgtgcatcccagacgacgcgcttgtcctgccattgttcggcgggtattttgtctttcagcgtcgggaagccggtcatattgccaatcgggaagatatcgtgcgggaccagcacggtggctggcgcggcgcaaatagccgcgacgatacgcccggaacggtggaactgtttaacggtttcaaccagcagggtgctatcgcgaaaacactctgcgcctttgatgccaccaggcagcacaatcacgtcatattcgccatcagccacttcaaccagcggcgcatccgccagcagcttcacgccgcgcgagcaggtaatcgccaggttaccatcgctggcgacgctggcagtggtgactttgataccgccgcgaaccagcagatcgatagtggtgacggcttcagtctcttcactaccaggggcgaggcaaaccagtgccgatgcgctcatattcactctcctttctttttaccatttcaaacaggcgggtgttttccggtacggcaatcccatgcgcgcgggcgcggcgtaagagaaaaccattgatatagtcgatttcggtgtggcgcagcgcgcggatatcctgcaacatcgacgagatattttccgctgttgcatcaatcacctgcatcacgtaatcacgcaaatcttctgctgaagtatgatgcccttcgcgttcgatcactgccgcgacttcttcgcatatctgcataatttcttgcggatgatgacgtaattcaccattcgggcaattccagatggcggtcagtggattaatcacacagttgactgccagcttgcgccacaactcagcgcgaatattgttatgccacgcgacgtcaggcaatacggtttgcaaaatatccgccagataactgtaatcgccgtcctgttgccgtgccggaccaatatgcgtgataccgtttgccacatgaataatgacattgccgtcgcggcgggcggcatgggtggtggtgcccatcagtaatggctgctgaatgttttgcaactcttcgatggtgcccatgccgttgtgaattaacagtattggcgtggttacaggcagtgtggacgcgaggcttttgacggcatcggaaacctgccatgctttcagcgtcaccaggagcagatcgctggtggcgagaaaatcgggatcgttggcggtcagcgattcgttaaatatcgaaccatctgtctcaaccagattcacactacaataaggttgcggtacgcgcagccagccctgaacgtcgtgaccctgtttacaaagtgctgtaagccataattgtcctaaggcaccgcatcccaatacggtaattttcattgttcctcctcacccgcaaccaccccgggtgttcaataaggctatcccttaattgtgcatgctgttgcgactatgcacaattaagggatacgtcctggtgcaggactgttggttatttaactttgcaggtattatgcttcgcatcaaaaatgaagggagaggaaaagatgccatctttcgatattgtctctgaagttgatcttcaggaagcacgtaacgcggtcgataacgcgagccgcgaagtggagtcccgttttgacttccgtaacgttgaagcctcatttgagctgaatgacgccagcaaaaccatcaaagtgttgagcgagtccgacttccaggtcaatcagttgctggatattctgcgtgccaagttgctgaagcgcggcattgaaggcagttcactggatgtaccggaaaatatcgttcatagcggtaaaacctggtttgtggaagcgaaactgaaacagggcattgagagcgcgactcagaagaaaatcgtcaaaatgatcaaagacagcaaactgaaagtgcaggcgcaaattcagggcgatgagatccgtgtgacgggcaaatctcgtgatgatttacaggctgtcatggcgatggtacgtggtagcgatctcggtcagccgttccagttcaaaaacttccgcgattaatcgcgacaacctgtgctttgttcatgtcagatgcggcatgaacgcctgattcggcctacaaaggtttgtaactcaggaacttagtaggcctgataagcgtagcgcagcaagcaatttcgcctcgcttttatgcctggcgaattgcctgttcaacctcaaagcgattcgtcactttgctgtcgattttcacataagctgaatgttcttcttctgcaatcaacacttctttgatgccttcagtttccagcaaacgcacttttaacgcctcgtttgcggcaatgttcgccgggatttcaatgcgcaagctgctgacatacggcggttctttcatggtactggcgactgccagccacactgcggccagcattgcgccagcgagaaatactccctgaccgtcaaacatgccgtcaatccagccgcccagcgaaccgccaatcgccacgccaagaaactggctggtggagtaaacacccatcgccgtacctttgtaacctgctggcgattctttactgataagtgaaggcagaagggcttccatcaaattaaacgccacaaagaaaagctgcacgccgaccaccagttgccagaactgcgtttgtgcgttccacaacacaatttccgcaaccacgatcaacccgacgcagaagacaaagacttgcttcattttgcgcttaacttcagcgtagataatgaaaggcacgaccgagccaaaggcgattaacatcgttgccaggtagaccttccagtgttcagccgccggtaaccccgcatcagccatctgtccgggcagggcaacaaaggtcgacatcagcaaaatatgcagacacataatgccaaagttgagtttcagcagccgcggttccgccagcactttactgaaactgcctttcaccattccggactcacgattaagtacgtgagtgctactgttgggcacaacccaaatggtcaacgcaatgccggttgttgccagaatagcgatcatccagaacagcgcgtgcagcccaagtttgtgagtgatgatcgggccaagcaccatcgcaatggcaaaggtaatgccaaagctcacgccgataaacgccatcgctttggtgcggttttgttcgcgcgtgagatcggaaagcagcgccataacagcagcggcaatcgcaccggagccttgtagcgcccggcccagaataattccccagatggagtcagagagcgcagcgataacgctaccggcggcaaacaccgccagcccaccgacaattaatggtttgcgaccaatgcggtctgaaagcaggccaaacggaatctgaaaaacggcctgagtcagaccataaataccaatggcaataccgattaatgcttcgctggcaccttgcagagccatgccgtacgtggtcagaaccggcagaaccatgaacatgcccagcatgcgtaatgaaaatacggtccctaaaccccaggtcgcgcgccgctcacctggcgtcattttataatcgttcattaccacctctgttttaaattcgcgactagtgtaaagcggcaaacgaatggggtaaacatgcggattttttagtaaatatttcgagagggatatgattctaatgctaagaaaaaaggtgccgtagcacctttttaactgagaggttgtgttaccacacagcagccagcagcgtatgcgagtccggcaccataaaatcaacggacatcatcaccgagagggcagtgatggcgatgatagagaaaccgaacagcttgcgcgcccagattctgtcatcagcaactttatagccgcgcagagccatgcctaaccaccagacgctcaccgcagcggcgaccaccagatatttatacccagcgtagccgccaagagagagcatcagcgtggcaacggcaaaggcgatgatatacagcgtgatgtgattcttcgccaccgaaatgcctttcaccaccggcagtaccggaatgtttgccgcctgataatccttaaagcggaaaatggctatggcataagagtgaggcatctgccacaggctgaagatagccagcaggatcgctgcgccgctatcgaactcgccggttaccgcacagtaaccgatcaccggaggcgcagcgccggagagcgaaccaatcaatgtgccgtagacagaatgacgtttcatgtacaggctataaacgccgacataaaccacaaagcccatcacccccagccagcaggccagcggattcgcgccaaaccacagcagcataaagccagcaatacccagcaaggtggcgtacaccagcgagacagcaggagagatcaggcctttcaccagcacccgattcttcgtcctttccatctttcggtcgatatccctgtcgatgtagttgttaaacacacaacccgacgccacaaccagtgacaccccaaccagcgtgtagataaacaggggataatcaatgctgccctttgaggccaacaggaatcccccaatcaccgagatcaggttgccaaagatgatgcctggtttcgttacttgcaggtattgcttaaatatcataaccgccgctcttagtgcatcatcatgttgtagttgaggttccacataatccaaatggagcccacaaccaggatggcgatgattagcacggtgaagacaaatgccgtcatattccagccttcatctgatttggtattcatgtgcaggaagcacaccagatgcaccagaatctgtaccactgccattgccaggattgttcccagaattacggccggagaggcagcccctgtcatcaccatccagaacggaattaccgtcaggattatcgacaggataaagcctgtcatgtaggtctttacgctgccatgggatgcgccgctgcttgcgttagaatgactcattacatcgcccccatcagataaacaacagtgaacacacagatccaaaccacatccaggaagtgccagaacaggctcaggcacatgatgcgggtacggttagtgctggtcaggccgcgacgggcgatttgcaccatcagcaccgccatccagataagaccggaagtgacgtgcagaccgtgcgtgccgaccagcgcaaagaatgctgacaggaagccgctgcgatccggacccatgccgttaacaatcaggtgatggaattcatagatttccatcccgataaatccggcaccaaacaaccatgtcaacgccagccaggagatcacctggcttttgttgtttttgtacatggcgatagccgccatgccgtaggtgatggagctgaacaacagcaagaaagtttcaaccagaacgaacggcagttcgaaaatgtccttacctgtcggcccacctgcggtgccgttcaccagaacggcataggtagcaaacaagatagagaacagaatgcagtcgctcatcaggtagatccaaaatccgaagattttggttccgcctgcatcgtggtgcccgtgttcgtgcgcgtgggcagtcgcgtgcgtcaaagtatcagttgccatttttcagccctgccttagtaatctcatcgaaatgctggttttccagtttttcgatttctgccaccggcacgtagtaatccacgtcctcgtcgaagcttttcacgatccaggtgatgatcatgcctgcgaagccaacaatcgccagccaccagatatgccagatcatggcgaaaccgaagatggtggagaaagccgcaatgacgataccggcaccgctgttttttggcatatgaatttcttcatagtggtcaggctttttgtacgcttcgcctttctctttcatttcccagaatgcatcacgttcgtgaacgtgcggcacaacggcaaagttatagaacggaggcggggaagaggttgcccactccagcgtacggccaccccacgggtcgccagtcaggtcacggttctggtcgcggtcacgaatagaaacgtacatctgaataacgaggcagagaatacccagcgcaatcagtaccgcaccgctggctgcaatcatcagcatggtgtggaactgcgggtcaatctgctggctcaaacgacgggtcatgcccatgaagcccagcgcatacagtggcataaaggcaacgaagaagccgatgatccagaaccagaacgcgcgtttaccccaggtttcgttcagtttgaaaccgaacgctttaggccaccagtaggtcatccctgcgaagcagccgaagaccacgccgccgatgatcacgttatggaagtgcgcaatcaggaacaggctgttatgcagaacgaagtccgcgcccggtactgccagcagcacgccagtcatcccgcccaccgagaaggtgacgataaaaccgatggtccacagcatcgcagaatggaacacgatgcggccctgatacatggtgaacagccagttgaagatcttcaccccggtcgggatggcgataatcatcgtggtgataccaaagaaggcgtttacgttcgcgcccgcacccatcgtaaagaagtggtgcagccagacgatgaacgacagcacggtgatacagacggttgcccataccagcgaggtataaccaaacagacgtttacgcgagaaggttgccgcaatttcggagaacacaccgaatacaggcaggatcaagatgtaaacttccgggtggccccaggcccaaatcaggttgatatacatcatcatgttgccacccatatcgttggtaaagaaatgggtgcccagatagcgatccagggtcaacaacgcgacggtaaccgtcagaattgggaaggaagcaataatcagtacgttcgcgcacagtgatgcccaggtaaatactggcatcttgaacatggtcatgcccggtgcgcgcatcttcagaatggtaacgaagaagttgataccggtaagcgtcgtacctataccggatagctggagactccatatccagtaatcgacaccgactcccggactgtactctattcccgatagcggtggataggccagccagccggtctgcgcaaattcgcccacgccgagagaaacgttaaccagaatcacaccaacaacggtaaaccagaagcttaagttgttgaggaacgggaacgcaacgtcacgcgcgccgatctgcagcggaaccaccaggttcatcagaccgataacgaaaggcatcgccacgaagaagatcataatcacgccatgcgcggtgaagatctgatcgtagtggtgaggtggcaggaagcccgcttcgcccgcagaggcaagggcctgctgactacgcatcataatggcgtcagcaaaaccacgcagcaacatcacaatcgccacgatgatatacatgataccgagacgtttatggtcaacggaggtcagccactctttccacaggtaggtccacttaccgaagtaagtgatcaggccaacgagcgccagacctcccaaaataatgccagcgatcgtaaccatgacgataggttcatggaacgggactgcatcaagtgataattttccgaacatctttattcttcctcaacccctttaatgggcggattccgcgtggctcatgtccatgccttccataccttcatgtgcgctgtgctcaccttctggctgggtcatgtccatgctcttaccgtgagccataaacttgttaatcacatcggcaaacaagtctggtttcacgttggagaaatattccacctggttgtattcgctaggcgcggccagtttttcgaacgctgccatgtcagacatgctgttcggcgactgtttcgcttttgcgacccattggtcgaatgcggcgcgatccggtgttgcaatagctttgaacttcatgcctgagaagcccgggccgctgtagctggcggagataccgtcataagtaccgggttcgttggcgatcagatgcaggcgagtctgcataccggccatggcataaatctggctacccagacgcggaatgaagaaggagttcatcacggagttggaggtcactttgaagtacaccggagtgttcgccgggaaagcgatttcattcacggttgcaatgccctgttccgggtagatgaagaaccatttccagtccatggaaaccacttcgatggtaatgggcttctcgtcgtgtgccagcggcttgctaggctcaagagcgtgagtggttttccaggtcagtaccgcaaggaagatgatgattaagataggtaccgtccagaccacagcttccactttattggagtgtgaccagttcgggctgtacttagcatctttattgctcgcacggtacttccaggcgaaaccaacagccatcaagattgcgggaataacgacaatcaacatcaggccaaatgccgtcagtatcagtgaacgttgctccagaccaatctgtcctttgggatctaacagcgcagaattacagccactgagcaatacagtgcctgcaaataatgacaaccatcccaaacttttattgtatttcctgagtctcatttaacgacctcaattccacgggatctggtggcgtttaaagtgtgtgggcattttacgggaaggttacattactgtaaacatgattaaattcctgttacttggatttggctgtcaggtcacatatgttgcaaaacatatcaagttgattttaagaagctgttgcaaaagggcgttataacgaaaggggagtgcagaaggagtttgggtgggcaattggtataatcaatataaaataaaacaattatttaacaaataattatcattgaggtgacagctgggtggtgagaaaataaggactcattagctgaatcgtgtaagaaaaatagaattcataaattgcgtcaataatttccaaacgctaagccgcacaaaagaacaaatattaataagcgatgctgatgtttatttagccgtaataattacggcgagtgattactacagctaaataatatttacagattacgtcagatgtgtttttcgtagcgccagataatccagcaaaccaccaagcacaacgccagaaagggcgactaaaaccccgacttccagcagcgcaggcaggaaagagaagtgcgtcaaatccagcgcgtccattgtcaacagcagtaaccacacggccaacaggctgatacccgccgccagtgtccacatggcaaaggcataacctgcaggatattcggtacgggagataaagttgccatttactcgtgtatattcaagcgtctggcggcaaaccagcagcaaaataagccctggtacggcagcggcgacggagaatagatagaatgtcgaccagccatgtgcttcaacaaaccaacccgccacggggccgacataaactcgccctacagcagaaagcgctgagagcagggcaaattgagtagcggaaaatgacttattacacagcgtcattaacagcgcgacaaaggctgatgtacccatcccgccacagaggttttcgaaaaagacggctgcacccatgctgtagagatgcttatcagtaatcgacagtagccagtaaccggcgttagatgcaccttgtaaaatgccgaaaatcagcagtgcacggaacagcgacaggcgctgcatcaaaatcccaccgtacaatgcgccaacaatggtcgccagtaagccaagcgttttgttaaccacgcctacttcacccgcatcaaacccgacgccgcgaatcaaaaacgtggttgtcaggctcatagcgaatgcgtcgcccagcttatacagcacgataagaagcaaaataagccaggcattattgcgaccaaagaaatctcgcagaggtgcaacaaccgcttgttccagcgttttgggcacaggaatggtgtcggtgggttctggtgcaagcaacgtcgcgataatacaggggatcaacagcaccgccatcaaccagtacatgccctgccagcccagccatttatctgccagccacagggctaagccgccggaaaccagcatccctaaacggtaacccagcacgctgattgccgcgcccgcaccacgttcttctgccgggagcacatcggttttccacgcatcgaagacaatatcctgggaggcagagcaaaaagcgatcaccaccgccagtgccgccatccagcggagctgggtgcctggttcgagaaaacccatcgccgcaatggcgactaataacagaatttgcgtggcgagcagccaaccgcgccgccgcccgaaaaatgggggcgtgtagcggtccatcagtggtgaccagaggaatttaaaaacgtaagcctggcctaccagagagaagaaaccaatggttttgagatcgatattctcgaccgtcatccaggcctgtaaggtgccggacgtcagggcgagcggtagcccggaagcaaaacccaggatcagcaatatggctgaacgcggctgttgaaaaatacgtaaatattgactggacatgggcgtctacaggcccggcttgcaccgggccagagggcagaaattaacgcgcgttctgcttgatgaattcgtggatgctggtgtcctgagacatatcagcgatggtatcggtcagcacactgttaaccgcatcggcgatatttttgttggaggcctggaacgcaccttcaacgttgtagctggcacgatagtttttggtcattttgttgccattctgcgcggtagcgatgatggcgatatccgctttggtcgcgatgttgtagcgcacgttgccctgggacacgtcagcatacagttggctaacgatgatttgcagattaaccgggccattcggaccaaccatgtatccacgggcggtcatttgtttttccagcacttcttgcagcaggaaacgcagatcgcgggaggcggtcagggtaacgatttgattatcgcgggtgacttttgccagcgcctgatcggtacgctgatcggcaccattaatgcttacggtgacgcccatcaggcttggatcctgctgtggcagtgtaatcgtcggggaaacttcgatagttgttggcggttttgcgcatcctgcaagcataaacagagcaactaacgggaagaggatttttttgaacatgttcgggctctcagagactcttaagcgtgtttggtaaaaattcccgccatcataacattgccaacggcgaggggaagtgggtaaggcatgtaaattcatcatgttgacgaaataatcgcccctggtaaaagaaacgctgatgcgaggcctgtgtttcaatctttaaatcagtaaacttcatacgcttgacggaaaaaccaggacgaaacctaaatatttgttgttaagctgcaatggaaacggtaaaagcggctagtatttaaagggatggatgacatctcagcgttgtcggaggagatatttcatgatgatacgtgagcggatagaagaaaaattaagggcggcgttccaacccgtattcctcgaagtagtggatgaaagctatcgtcacaatgtcccagccggctctgaaagccattttaaagttgtgctggtcagcgatcgttttacgggtgaacgttttctgaatcgtcatcgaatgatttacagtactttagcggaggaactctctactaccgttcatgcgctggctctgcatacttacactattaaggagtgggaagggttgcaggacaccgtctttgcctctcctccctgtcgtggagcaggaagcatcgcgtaaaaacgcatttgcaactgtcggcgcttttccagtatgttgctaaagattttatgaaaaacggcctgcgggccgttttgttttgtctggattttgcgctttttgcccagcattcagacgaaaatcgcccgggaattgtgaaaaaatacgcgacagcgcgcaataaccgttctcgactcataaaagtgatgccgctataatgccgcgtcctatttgaatgctttcgggatgattctggtaacagggaatgtgattgattataagaacatcccggttccgcgaagccaacaacctgtgcttgcggggtaagagttgaccgagcactgtgattttttgaggtaacaagatgcaagtttcagttgaaaccactcaaggccttggccgccgtgtaacgattactatcgctgctgacagcatcgagaccgctgttaaaagcgagctggtcaacgttgcgaaaaaagtacgtattgacggcttccgcaaaggcaaagtgccaatgaatatcgttgctcagcgttatggcgcgtctgtacgccaggacgtcctgggcgacctgatgagccgtaacttcattgacgccatcattaaagaaaaaatcaatccggctggcgcaccgacctatgttccgggcgaatacaagctgggtgaagacttcacctactctgtagagtttgaagtttatccggaagttgaactgcagggtctggaagcgatcgaagttgaaaaaccgatcgttgaagtgaccgacgctgacgttgacggcatgctggatactctgcgtaaacagcaggcaacctggaaagaaaaagacggcgctgttgaagcagaagaccgtgtgaccatcgacttcaccggttctgtagacggcgaagagttcgaaggcggtaaagcgtctgatttcgtactggcgatgggccagggtcgcatgatcccgggctttgaagacggtatcaaaggccacaaagctggcgaagagttcaccatcgacgtgaccttcccggaagagtaccacgcagaaaacctgaaaggtaaagcagcgaaattcgctatcaacctgaagaaagttgaagagcgtgaactgccggaactgactgcagaattcatcaaacgtttcggcgttgaagatggttccgtagaaggtctgcgcgctgaagtgcgtaaaaacatggagcgcgagctgaagagcgccatccgtaaccgcgttaagtctcaggcgatcgaaggtttggtaaaagctaacgacatcgacgtaccggctgcgctgatcgacagcgaaatcgacgttctgcgtcgccaggctgcacagcgtttcggtggcaacgaaaaacaagctctggaactgccgcgcgaactgttcgaagaacaggctaaacgccgcgtagttgttggcctgctgctgggcgaagttatccgcaccaacgagctgaaagctgacgaagagcgcgtgaaaggcctgatcgaagagatggcttctgcgtacgaagatccgaaagaagttatcgagttctacagcaaaaacaaagaactgatggacaacatgcgcaatgttgctctggaagaacaggctgttgaagctgtactggcgaaagcgaaagtgactgaaaaagaaaccactttcaacgagctgatgaaccagcaggcgtaatttacgtagtataacgctctaaattcgcacaaaggcccgtcaccgccaggtggtgggcttttttttgtcatgaattttgcatggaaccgtgcgaaaagcctctttcggtgttagcgtaacaacaaaagattgttatgcttgaaatatggtgatgccgtacccataacacagggactagctgataatccgtccataaggttacaatcggtacagcaggttttttcaattttatccaggagacggaaatgtcatacagcggcgaacgagataactttgcaccccatatggcgctggtgccgatggtcattgaacagacctcacgaggtgagcgctcttttgatatctattctcgtctacttaaggaacgcgtcatttttctgactggccaggttgaagatcacatggctaacctgattgtggcgcagatgctgttcctggaagcagaaaacccagaaaaagatatctatctgtacattaactctccaggcggggtgattactgccgggatgtctatctatgacaccatgcagtttatcaagcctgatgtcagcaccatctgtatgggccaggcggcctcgatgggtgctttcttgctgactgcaggggcaaaaggtaaacgtttctgcctgccgaattcgcgcgtgatgattcaccagccgttgggcggctaccagggccaggcgaccgatatcgaaattcatgcccgtgaaattctgaaagttaaagggcgcatgaatgaacttatggcgcttcatacgggtcaatcattagaacagattgaacgtgataccgagcgcgatcgcttcctttctgcccctgaagcggtggaatacggtctggtcgattcgattctgacccatcgtaattgatgccagaggcgcaactgtgccgctatacttatccagggcggcacaacgctgtaagcggcttgcgcctgagaatggcatttgcgtcgtcgtgtgcggcacaaagaacaaagaagaggttttgacccatgacagataaacgcaaagatggctcaggcaaattgctgtattgctctttttgcggtaaaagccagcatgaagtgcgcaagctgattgccggtccatccgtgtatatctgcgacgaatgtgttgatttatgtaacgacatcattcgcgaagagattaaagaagttgcaccgcatcgtgaacgcagtgcgctaccgacgccgcatgaaattcgcaaccacctggacgattacgttatcggtcaggaacaggcgaaaaaagtgctggcggtcgcggtatacaaccactacaaacgtctgcgcaacggagataccagcaatggcgtcgagttgggcaaaagtaacattctgctgatcggtccgaccggttccggtaaaacgctactggccgaaacgctggcgcgcctgctggacgttccgttcaccatggctgacgcaaccacgctgaccgaagccggttatgtgggcgaagacgttgaaaacatcattcagaagctgttgcagaagtgcgattacgacgtacagaaagcgcagcgcgggattgtctacatcgatgaaatcgacaagatttctcgtaagtcagacaacccgtccattacccgagacgtttccggtgaaggcgtacagcaggcactgttgaaactgatcgaaggtacggtagctgctgttccgccgcaaggtgggcgtaaacatccgcaacaggaattcttgcaggttgatacctctaagatcctgtttatctgtggcggtgcgtttgccggtctggataaagtgatttcccatcgtgtagaaaccggttccggcattggttttggcgcgacggtaaaagcgaagtccgacaaagcaagcgaaggcgagctgctggcgcaggttgaaccggaagatctgatcaagtttggtctgatccctgagttcattggtcgtctgccggttgtcgcaacgttgaatgaactgagcgaagaagctctgattcagatcctcaaagagccgaaaaacgccctgaccaagcagtatcaggcgctgtttaatctggaaggcgtggatctggaattccgtgacgaggcgctggatgctatcgctaagaaagcgatggcgcgtaaaaccggtgcccgtggtctgcgttccatcgtagaagccgcactgctcgataccatgtacgatctgccgtccatggaagatgtcgaaaaagtggttatcgacgagtcggtaattgatggtcaaagcaaaccgttgctgatttatggtaagccggaagcgcaacaggcatctggtgaataattaaccattcccatacaattagttaaccaaaaaggggggattttatctcccctttaatttttcctctattctcggcgttgaatgtgggggaaacatccccatatactgacgtacatgttaatagatggcgtgaagcacagtcgtgtcatctgattacctggcggaaattaaactaagagagagctctatgaatcctgagcgttctgaacgcattgaaatccccgtattgccgctgcgcgatgtggtggtttatccgcacatggtcatccccttatttgtcgggcgggaaaaatccatccgttgtctggaagcggcgatggaccatgataaaaaaattatgctggtcgcgcagaaagaagcttcaacggatgagccgggtgtaaacgatcttttcactgtcgggaccgtggcctctatattgcagatgctgaaactgcctgacggcaccgtcaaagtgctggtcgaggggttacagcgcgcgcgtatttctgcgctctctgacaatggcgaacacttttctgcgaaggcggagtatctggagtcgccgaccattgatgagcgggaacaggaagtgctggtgcgtactgcaatcagccagttcgaaggctacatcaagctaaacaaaaaaatcccaccagaagtgctgacgtcgctgaatagcatcgacgatccggcgcgtctggcggataccattgctgcacatatgccgctgaaactggctgacaaacagtccgttctggagatgttcgacgttaacgaacgtctggaatatctgatggcaatgatggaatcggaaatcgatctgctgcaggttgagaaacgcattcgcaaccgcgttaaaaagcagatggagaaatcccagcgtgagtactatctgaacgagcaaatgaaagctattcagaaagaactcggtgaaatggacgacgcgccggacgaaaacgaagccctgaagcgcaaaatcgacgcggcgaagatgccgaaagaggcaaaagagaaagcggaagcagagctgcagaagctgaaaatgatgtctccgatgtcggcagaagcgaccgtagtgcgtggatatatcgactggatggtacaggtgccgtggaatgcgcgtagcaaggtcaaaaaagacctgcgtcaggcgcaggaaatccttgataccgaccattatggtctggagcgcgtgaaagatcgtatccttgagtatcttgcggttcaaagccgtgtcaacaaaatcaagggaccgatcctctgcctggtagggccgccgggggtaggtaaaacctccctgggtcagtccatcgccaaagccaccgggcgtaaatatgtccgtatggcgctgggcggcgtgcgtgatgaagcggaaatccgtggtcaccgccgtacttacatcggttctatgccgggtaaactgatccagaaaatggcgaaagtgggcgtgaaaaacccgctgttcctgctcgatgagatcgacaaaatgtcttctgacatgcgtggcgatccggcctccgcactgcttgaagtgctggatccagagcagaacgtagcgttcagcgaccactacctggaagtggattacgatctcagcgacgtaatgtttgtcgctacgtcgaactccatgaacattccggcaccgctgctggatcgtatggaagtgattcgcctctccggttataccgaagatgaaaaactgaacatcgccaaacgtcacctgctgccgaagcagattgaacgtaatgcactgaaaaaaggtgagctgaccgtcgacgatagcgccattatcggcattattcgttactacacccgtgaggcgggcgtgcgtggtctggagcgtgaaatctccaaactgtgtcgcaaagcggttaagcagttactgctcgataagtcattaaaacatatcgaaattaacggcgataacctgcatgactacctcggtgttcagcgtttcgactatgggcgcgcggataacgaaaaccgtgtcggccaggtaaccggtctggcgtggacggaagtgggcggtgacttgctgaccattgaaaccgcgtgcgttccggggaaaggtaaactgacctataccggttcgctcggcgaagtgatgcaggagtctattcaggcggcgttaacggtggttcgtgcgcgtgcggaaaaactggggatcaaccctgatttttacgaaaaacgtgacatccacgtccacgtaccggaaggtgcgacgccgaaagatggtccgagtgccggtattgccatgtgcaccgcgctggtttcttgcctgaccggtaacccggttcgtgccgatgtggcaatgaccggtgagatcactctgcgtggtcaggtactgccgatcggtggtttgaaagaaaaactactggcagcgcatcgcggcgggattaaaacagtgttaattccgttcgaaaataaacgcgatctggaagagattcctgacaacgtaattgccgatctggacattcatcctgtgaagcgcattgaggaagttctgactctggcgctacaaaatgaaccgtctggcatgcaggttgtgactgcaaaatagtgacctcgcgcaaaatgcactaataaaaacagggctggcaggctaattcgggcttgccagcctttttttgtctcgctaagttagatggcggatcgggcttgcccttattaaggggtgttgtaaggggatggctggcctgatataactgctgcgcgttcgtaccttgaaggattcaagtgcgatataaattataaagaggaagagaagagtgaataaatctcaattgatcgacaagattgctgcaggggctgatatctctaaagctgcggctggccgtgcgttagatgctattattgcttccgtaactgaatctctgaaagaaggggatgatgtagcactggtaggttttggtacttttgccgtcaaagagcgtgctgcccgtactggccgcaacccgcagaccggtaaagagatcaccatcgctgctgctaaagtaccgagcttccgtgcaggtaaagcactgaaagacgcggtaaactaagcgttgtccccagtggggatgtgacgaagttcaagggcgcatctactgatgtgccttttttatttgtattcggtgactttctgcgtcttgtgggctgacaattgcccccgtttcttgtcacaataggcctttgcgcgcatcgatacgttgcgtgaggtacacagtcatctacagcggagtgttgttacaccatgatggacagcttacgcacggctgcaaacagtctcgtgctcaagattattttcggtatcattatcgtgtcgttcatattgaccggcgtgagtggttacctgattggcggaggcaataactacgccgcaaaagtgaatgaccaggaaatcagccgtgggcaattcgagaacgccttcaacagcgagcgtaatcgcatgcagcaacagctgggcgatcaatactccgagctggcagcgaacgaaggctatatgaaaaccctgcgtcaacaggtgctgaatcgtctgatcgacgaggcgcttctggatcagtacgctcgtgagctgaaactgggtatcagcgatgagcaggttaaacaggcgattttcgcgaccccagccttccaggttgatggcaaatttgataacagccgctataacggtatcctcaaccagatggggatgaccgccgatcagtacgcccaggcgctgcgtaaccagctcactacccaacagctgattaacggcgttgccggtaccgattttatgctgaaaggtgaaaccgacgagctggcggcactggtagctcaacaacgcgtggtgcgtgaagcgactatcgatgttaacgcgctggcggcgaagcagcctgtgaccgaacaggaaattgccagctactacgaacaaaacaaaaacaatttcatgacgccggaacaattccgcgtgagttacatcaagctggatgccgcgacgatgcagcaaccggttagcgatgcggatatccagagctactacgatcagcatcaggatcaattcacccagccgcagcgtacccgttacagcatcatccagaccaaaactgaagatgaagcgaaagcggtacttgatgagctgaataagggcggtgattttgctgcattagccaaagaaaaatctgccgatattatctctgcccgcaacggcggtgatatgggttggttagaagatgccactatcccggacgaactgaaaaatgcgggtctgaaagaaaaaggccaactgtctggtgttatcaaatcttcggtcggtttcctgattgtgcgtctggacgacattcagccagcgaaagtgaaatcgttagacgaagtacgtgacgacattgcggcgaaagtgaaacacgaaaaagccctcgatgcgtactacgcgctgcagcagaaagtgagcgatgcggcaagcaacgacaccgagtctctggccggtgcagagcaagctgccggcgttaaagccactcagacgggttggttcagcaaagataacctgccggaagagttgaacttcaagccagttgccgacgctatcttcaacggcggtctggtaggtgaaaacggcgcgccgggcatcaactctgacatcatcaccgtagacggcgaccgcgcattcgtgctgcgcatcagcgagcacaaaccggaagcggtgaaaccgttggcagatgttcaggaacaagttaaggcactggttcagcacaacaaagctgaacaacaggcgaaagtggatgctgagaaactgctggttgatttgaaagcaggcaaaggtgcggaagctatgcaggctgccggtctgaaatttggcgagccgaaaaccttaagtcgttccggtcgtgacccgattagccaggctgcgtttgcactgccgctgccagcgaaagacaaaccgagctacggtatggcgaccgatatgcaaggtaatgtagttctgctggcgctggatgaagtgaagcaaggttcaatgccggaagatcagaaaaaagcgatggtgcagggtatcacccagaacaacgcacaaatcgtctttgaagctctgatgagtaacctgcgtaaagaggcgaaaatcaaaattggcgatgcgctggaacagcaataatcctgaagccgcctcgcaaaaaaatgctttgcagctgtaacaagaaaaggtcgctttcgcggccttttccatttctgaacattgccatttgtttactgttttcactgccgttaaggtgattccactgttaacaaacaaggagaaaacagtatgaaacacggaattaaagcactgctcattaccctgtccctggcctgtgccggaatgtctcatagtgctctggcggcagctcctgcggcaaaaccgacaacggtagaaaccaaagcggaagctcctgcagcacaaagtaaagcagcagttccggcgaaagccagtgacgaagaaggcacccgggtcagcattaataatgccagcgcggaagagttagcccgcgcgatgaatggcgttggcctgaagaaagcgcaggcgattgtcagttatcgcgaagagtacggtccgtttaaaacggtggaggatctaaagcaggtgccggggatgggcaattcgctggtggaacgtaatctggcggtattaaccctgtaattaatttgcatagtggcaattttttgccagactgaagaggtcataccagttatgacctctgtacttataacagttcttataacaacaacgtaaggttattgcgctatgcaaacacaaatcaaagttcgtggatatcatctcgacgtttaccagcacgtaaacaacgcccgctaccttgaatttctcgaagaagcccgctggcatgggttggaaaatagcgacagttttcactggatgacggcccataacatcgctttcgtcgtggtcaatatcaatattaactatcgccgcccggcggtattaagcgacctgttaaccattaccagtcagttgcagcaattaaacggtaaaagtggcatcttaagccaggtcattacactggagccggaaggacaggtggtagcggatgcgcttattacgtttgtttgtattgatcttaaaacgcagaaagcattagctctggaaggggaattgcgcgaaaagctggagcagatggttaagtaaacgttttgtggtaccggatgctcaagccgcatccggcgacacccggaataattacttcaacccggttttctgcttcatcgctgccatcaccgtcggtttatcggccagataatgattcaaaccgttggcacgtaaattacacgccgcacaatgaccgcaaccgtcgcctttaatgccgttataacaggtcagcgtttcgttacggactaaatccagcttgccgtaataatctgccagcgcccaggtttccgctttatcaatccacatcagcggcgtttcaaaacgaatatctttcgccatgcccaaactgacggcatggtttagtgctttcacaaactcatcgcggcaatccgggtagccggagaaatccgtttcgcagacgccggtaattacggcttctgcttttacctgatacgcatatattgccgccagtgtcaggaacaaaatattacgccctgggacaaacgtattcgggataccatcggcttcaggttcataatcaggcaccggaatgctgtcacgcgtcaggctgctgaccgccagctcgttgagcagcgttacatcaagcaccttatgcgcgcgtgcccccagtttcagcgccagttcgcgtgccacgtcgatttctgcgcgatggcgttgaccgtaatcgaacgtcacgcaatggacttcatcatattgttgtaatgcctgcaccagacaggtggtggaatcctggcctccactgaacacaacgacagcacgtttcatagataatcctgcttgaacaataaaaacgttatggtaacgcctgcgattaacccggaccagctattcattgcgacggcgcgggaagccaggcttcggtaaattcaaaccagccgcgcggtgtcagtcgcacaccgttcacgccgggaggggcgctaatgcgatagtgatagttgaacagcggcgtcagcgtcgcatctgccattaactggctaaaaaccgctttcagggcattaaatcggttttcctcatcaggcattacttgcactgcgtccagtgtcgattgcaaatgtgcatatgctggagcgtcgaaaacatgtggccacagtggatcgcaacgcagccattgctccagggtatattccggtgcttcgccaattaatctgtcgcccatcatgaggtctgcgtgtgccagtaggggcgtgtcgtcccagttttttgcgttatgaaaaataattgtgagttcacagccttccgctgccagtgtcgcctgtaggcgttctgccatggtatgaagttctatcggtaggtgataaaccagcgtcaaggttttcggtagtttaacttcatccggtacttgccaatgcggaatagtccagcctggcagtaatgcatgactggcagtgatcaggttttctccgacttctaacgtttgtaataaaccggattgatgaataatggagattacttttcgcgcctgccagagggacagtcggagacttttgcgcaatgttaaatagcaaaaacctaaactgatgccgctactgacctggctgacccgttgcagctcctccggtttgccaatggtgatttgcacgggatgccgacaactggttcccatatctttttcgaaaagcggcggagttatccagtactcaaccgctttaagcagcggatgacgtaaatggtaataatcatggctctccaggcgcaccagttccgctgtgaattgtgttaagcgaaaaggacctgtgccgatcagtgggaattgcggatgcgccagatggctgcaatagctcgccagtcggtgcgcaagccagtaatcggggcgatgtaaaaagaaggtcagacactgcggatgggtgacttcaatacgcttcacgctaataaataattgatccagtgctggcagttgtaacagcatcaataaccgctggtgtaagtgggaggcttttactgcatcgccgttatgccagtgtaaggttgagcgaagataaaaatcccagcgtaacccgtcagtagaggtttcccagtgatgcgctaaatcgccaatcgggcgctgggtattattatcgaagcgggtcaggccggaaaatatctgcccggccagatgctgctcggcacggccgggcaaaaagcccggttgtagcggttcgagcgggcgatagtagggaatacgcaacgtgggcgtatcgttttgccattgtccgcccataaacggctgtaacagagtgcgcaactcacctggggccagttgcgccagctccagcacatcttgctgctttccggtttccagcgcctgttccatcatcgcattgcgtagcgattctggcgtgaccagaaagcgcagttgaccgcgctttccgcgtcctgactgcgcctgccactccagccatcccgcctcctgtgcctggcgtaacagcgtacgaacatggcgttcgctgcaaaaacagcgttcggccagttcgctgacggtgacggtttgcggctttccggcggaaggttgccacagacgttgatactggttaagacggttgagcagtcgcatataaacccggaacaatattatttaactattcactattacttccgtatatatcaggtgatactcaatcaccattaaccgtgtcacagagtggagaaagaaatggctcgtctggcagcatttgatatggatggcactttattgatgcctgaccatcatttaggtgagaaaaccctctctactttggcgcggctgcgtgaacgcgacattaccctcacttttgccacggggcgtcatgcgctggagatgcagcatattctcggggcgctatcgctggatgcatatttgattaccggcaacggaacgcgcgtgcattctctggaaggtgaacttttacatcgtgatgatttacctgcggatgtcgcggagctggtgctgtatcagcaatgggatacccgagccagcatgcatatcttcaatgacgatggttggtttaccgggaaagagaaccctgcgttgttgcaggcatttgtctatagcggttttcgttatcagataatcgatgtcaaaaaaatgccactcggcagcgtcaccaagatctgcttctgtggcgatcacgacgatcttacacgcttgcagatccagctatacgaagcattaggcgagcgtgcacatttatgtttttccgccacggattgcctcgaagtgctgccggtgggctgcaataaaggcgctgtattgacggtgctgacccaacatttaggtttatcgttacgcgattgcatggcctttggtgatgcgatgaacgatcgcgaaatgttaggcagcgtcggtagcggatttattatgggcaatgcgatgccgcaactgcgcgcggagctcccgcatttaccggtgattggacattgccgaaatcaggctgtctctcactatttgacgcactggctggactatccacatctaccttattcccccgaataacgagatcccttccagcaccgggcaattgcccggttttttttgcgttgaatttgtcattttgtgccgtggtgcttaaaccgcacagaataaattgtcgcgatttcacctttaaaatagaattaaaagagaaaaaaattctctgtggaagggctatgttagataaaattgaccgtaagctgctggccttgctacagcaggattgcaccctctctttgcaggcactggctgaagccgttaatctgacaaccaccccctgctggaagcgtctgaaacggctggaggacgacggtattcttatcggcaaagtcgccctgctggatccggaaaaaataggcctcggcctgaccgcctttgtgctgataaaaacgcaacatcacagcagcgaatggtattgccgctttgtcacggtggttaccgaaatgccagaagtgctggggttctggcgcatggctggtgaatacgattatctgatgcgcgtccaggttgccgacatgaaacgctacgacgagttttataagcgtctggtaaacagtgtaccggggctgtcggacgtcacttccagcttcgcgatggaacagattaaatacaccacttctttacccatcgaataaatatccagaatcaagtcaggacacaacgcgtgcgattatttgctcaattaagctggtatttccgtcgggaatggcgtcgctatctcggggctgtcgccttgcttgtcattatcgcgatgctgcaactggttccgccaaaagtggttggtattgttgttgatggcgtgacagaacaacactttactaccgggcagatcctgatgtggatcgccaccatggtgctgattgccgttgtggtttatctcctgcgttacgtctggcgcgtattgctgtttggtgcgtcttatcaactggctgttgaactgcgtgaagattattaccgccagctaagccggcagcatcctgagttttacctgcgtcatcgcacgggtgacctcatggctcgtgcgaccaatgacgtcgatcgcgtcgtgtttgccgccggagaaggggtgctgacgctggtggattcactggtaatgggctgcgctgtgttgattatgatgtctacgcaaattagctggcagttgaccttatttgccctgttgccgatgccagtgatggcgatcatgatcaagcgcaacggcgatgccttgcatgaacgctttaagctggcacaggcggcgttttccagtcttaatgaccgcacccaggaaagcctcaccagtattcgcatgatcaaagcctttggtctggaagatcgtcagtcggcgttatttgccgcggatgccgaagataccggcaaaaaaaacatgcgggtggcgcgtattgatgctcgtttcgacccgaccatctatatcgcgattggtatggcgaacttgctggcgattggcggcggtagttggatggtggtacagggcagtttaacgctgggccagctcaccagttttatgatgtatttaggtctgatgatttggccaatgctggcgctggcatggatgtttaacattgtggaacgtggcagcgcggcgtatagccgaattcgtaccatgctggccgaagcgccagtcgttattgatggtagtgataaggtgccagaaggtcgtggtgaactggatgtgaatattcgccagtttacgtatccgcagactgaccatcctgcgctggaaaacgtcaatttcgccctgaaacccggtcagatggtaggtatttgcgggccgactggttccggcaaaagtaccctgttgtcgctcattcagcgtcatttcgacgtcagcgagggggatatccgctttcatgatattcctctgacgaagttacaactcgatagctggcgtagccgcctggcggtagttagccagacaccgttccttttttccgacaccgtagcgaacaacatcgcgttgggttgcccgaatgccacccagcaagagattgagcatgtcgcgcggttagccagcgtgcatgacgatattttgcgtttaccgcaaggttacgatacagaagtgggcgagcgcggcgtgatgctttccggtgggcaaaaacagcgtatctccattgctcgtgcgttattagtcaacgcggaaatcctcatccttgatgatgcgctttcggcagtagacggacgcacagagcaccagatcctgcataacctgcgtcagtgggggcagggaagaacggtaatcatcagtgcccatcgcctttctgcactgacggaagccagtgaaattattgtgatgctgcacggacatatcgcccagcgtggcaatcatgatgagctggcgcaacaaagtggctggtatcgcgatatgtatcgctatcaacaactggaggcggcgctcgacgacgctccggaaattcgcgaggaggccatcgatgcgtagttttagccaactgtggccgactctcaagcgcctgttagcgtacggttcaccgtggcgtaaaccgttggggattgcggtcctgatgatgtgggttgcggcggcggcagaagtcagtgggccgctgcttatcagctattttatcgacaatatggtagcgaaaaataacctgccgttgaaagtggttgcagggctggcggcggcgtatgttgggctgcaactgtttgcagccgggctacattacgcgcagtcgctgctgtttaatcgggcggcagtaggcgtagtgcaacagttgcgtaccgacgtgatggatgctgcgttacgccagccattaagcgagtttgatacccaacccgtcgggcaggtgatttcccgcgtcactaatgacactgaagtgatccgcgatctctacgttaccgtagtggcaactgtcctgcgtagcgccgcactggtgggcgcgatgctggtggcgatgttcagcctcgactggcgaatggcgctggtggcgataatgattttcccggtggtgctggtggtaatggtgatatatcagcgttacagcacgccgattgtccgtcgtgtgcgcgcttatctggcggatatcaacgacggctttaacgaaatcatcaatggcatgagcgttatccagcagttccgtcagcaggcgcgatttggcgaacgtatgggtgaggccagtcgttcacactatatggcgaggatgcaaaccctgcgcctcgacggttttctgctgcgtccgctgctgagtctgttttcatcgctcattctttgtggcttgttgatgctgtttggcttctccgccagcggcaccattgaagtgggcgtgttgtatgcgttcatcagttatttggggcgacttaacgaacccttaatcgaactgaccacgcagcaggcgatgctgcaacaggctgttgttgctggtgagcgcgtttttgagctgatggacggaccgcgccagcaatatggcaatgatgatcgcccgttgcagagcggcaccatcgaagtcgataacgtgtcatttgcttatcgcgatgacaatctggtgctaaagaacattaatctctctgtgccttcgcgcaactttgtggcgctggtcgggcataccggcagtggcaaaagcaccctcgccagtttattgatgggctattacccgctaacggaaggtgagattcgccttgatggtcgtccattaagttcgctaagtcacagcgcgctgcgccagggcgtggcaatggtgcagcaagatccggtggtgctggcggataccttcctcgccaacgtgacgctggggcgtgatatctccgaagaacgcgtctggcaggcgctggaaaccgtgcaactggcggagctggcgcgtagcatgagcgacggtatttacacgccgcttggcgagcaggggaataatctctcagtcgggcaaaagcaactgctggcactggcacgcgtgttggtggagacgccgcaaatcctgatccttgatgaggcaacagccagcattgactccggtactgaacaggcgattcaacatgctctggcggcggtgcgtgaacatactacgcttgtggtgattgctcaccgcttatcaactattgttgatgccgacaccattctggtgcttcatcgtgggcaagctgtggagcagggcactcaccagcaactgctggcggcccagggacgctactggcagatgtatcaactgcaacttgcgggcgaagagctggcagccagcgtgcgtgaagaggaatcattgagcgcctgaatagcgcaatatttcatcgttggtgcaaaaatgtaacgcactgtgcactgtcatagtgcgttttcattttcaatcttcttaacttcctgctctctttctcgtttttcatttctggcacaccgcttgcaataccttcttcgtgtagcagaaccattaccgaattctgaccggaggggatctatgaagctggtgaccgtgataatcaaaccattcaagctggaagacgttcgtgaagcgttatcttccattggtattcagggcctgaccgtcaccgaagtgaaaggtttcgggcgtcagaaagggcatgccgagctgtaccggggggcggaatacagcgtcaacttcctgccaaaagtaaaaattgatgtggcgattgctgatgaccaactcgatgaagtgatcgatatcgtcagcaaagcggcttacaccggaaaaattggcgacggcaaaatcttcgtcgctgaattgcaacgcgtcattcgtattcgtaccggcgaagccgacgaagcggcgctgtaatctctggcacacagcaacaggaacgaaaaatgaagatagcaacgataaaaactgggcttacttcactggcgatgctgccgggactggtaatggctgcacctgcggtggccgataaagccgacaatgcgtttatgatgatttgtacggcgctggtgctgtttatgaccgttccggggattgccctgttttatggagggctgattcgtggcaaaaacgtgctgtcgatgctgacgcaggtgaccgtgacgtttgcactggtctgtattctctgggtggtttacggctactcgctggcgtttggcgaaggcaacaacttcttcggcaacattaacgggttgatgctgaaaaacattgaactgacggcggtgatgggcagtatttatcagtatatccacgtggcgtttcagggatcgtttgcctgcattaccgtaggcttgatagttggggcgctggcggaacgaatccgcttctcagctgtgttgatttttgtggtggtatggctgacgctctcttacattccgattgcgcatatggtctggggcggcggtttgctggcttctcacggggcactggatttcgcgggtggcacggtggtgcacattaacgccgcaatcgccggtctggtgggcgcgtatcagataggcaaacgcatgggcttcggtaaagaggcgtttaaaccgcacaacctgccgatggtcttcaccgggactgctattctctatatcggttggtttggctttaacgccgggtcagcgggcacggcgaatgaaatcgcggcactggcatttgtgaatactgtggtcgcaactgcggcggcaattcttggctggatcttcggtgaatgggcgctgcgtggtaagccttcactgctgggagcgtgttctggcgcgattgccggtctggtcggcgtgacgccagcctgtggttacattggggttggcggcgcgttgattatcggcgtggtagctggtctggcgggcttgtggggcgttaccatgctcaaacgcttgctgcgggtggatgatccctgcgatgtcttcggtgtgcacggcgtttgtggtattgtcggctgtatcatgaccgggatttttgccgccagctcgctgggcggcgtgggcttcgctgaaggtgtgacgatgggccatcagttgctggtacagctggaaagcatcgccattacgattgtctggtctggtgtggtggcatttatcggctacaaactggcggatctgacggttggtctgcgtgtaccggaagagcaggagcgagaagggctggacgtcaacagccacggcgagaatgcctataacgcgtaacaagcactgcaaaaaacagccggacggttttcacctccggctatttttttaattgtgattacgcatcaccccttcctgaacggtcgaggcaaccagcacgccgtcctgggtataaaactcaccgcgcacaaagccgcgtgcgctggacgccgaggtgctttccacgctatacagcagccattcattcaaattaaacgggcgatggaaccacatggaatggtcaatggtggcaatctgaatccccggttcgagaaaaccgatgccgtgcggctgtagagctaccggcaggaaattaagatcagaagcataaccgagcagatactgatgaacgcgcagatcatccggcacgctaccatttgcgcggatccacacctgacgatgcggttctgcgacgtgacctttcagtgggttatgaaactccaccggacggacttccagcggacgatcgcagatgaatttatctttcagcactggcggcagcaggtgcgccagcgattgggcgatttgcgtttctgaaggcaggccatcaggcgctggcgcggacggcattgttttttgatgttcgaaacccgcttctggtgcctggaaagaggcagtcatataaaaaatcggtttgccgttttgaatagcagcaacccggcgggcgctgaagctgttaccgtcacgcagcgtttcgacatcataaataatcggcttcttactatcgccagggcgaagaaagtagctgtgaaaagaatgtaccagccgctcgtcagggacggtctcttttgcagcatacaaggcctgacccacgacctggccgccaaatacctggcgtaaacctaaatcttcactctggccgcgaaagagtccttcctcaattttttccagatttaacaatgtcagtaaattttttagcgcctgactcatataactctccagtaacaaagctgccgcagcaagccaaagtgagttgagtataacgcaaatttgccactggtccgatgggtgcaatggtctgaattacgggctaattacaggcagaaatgcgtgatgtgtgccacacttgttgacgttactattttgttaaccactcttccggcgaggaaagttagcccgctggtgcattgataataaggagaagtgaatgaaactcgtgcacatggccagtggtttagcggttgcgattgcgttggcggcttgcgcagataaaagcgcggatattcagacgccagcaccggctgcaaatacgtctatttcagcaacacaacaacctgctatccagcaaccgaatgtctccggtaccgtttggatccgtcagaaagtcgcactgccgcctgatgccgtgctgaccgtgacactttctgacgcgtcgttagccgatgcgccgtcgaaagtgctggcgcagaaagcggtgcgtaccgaaggtaaacagtcaccattcagctttgttttgccatttaacccggcagatgttcagccgaacgcgcgtattctgttgagtgcggcgattaccgtgaatgacaaactggtatttattaccgataccgttcagccggtgatcaaccagggcggaactaaagccgacctgacattggtgccggtgcagcaaaccgccgtgccggttcaggctagcggtggcgcaacgactaccgtaccttcaacttcaccaacccaggtgaatccgtcttcggcagttccagctccaacgcaatattaagcgaagttaaccctctccgcccggagagggttagtagttccagcgataaagctgcaagtcgatttgcccgcttcccgacaccatcacaccttctgccagtaatgcctgtcgctgacgctgtaaatccggtccggtcagtgaaatggtgccgtggcgattaaccacccggtgccagggcaaggtgctgccttcggggagacgctttaacacaccgccaacctggcgcgcggcacggggcgatcccgccagtttcgccacatcaccgtaagtggtgacatagccttcgggaatagcggctacgatttgccagacgcgttggggaaatgaatcttctttttccatcttttcttcctgaggtaatttttcagcataatctggaaaaacgcccgagtgaagccgcattgcgcaagaaaccagcatctggcacgcaatgggttgcaattagccggggcagcagtgataatgcgcctgcgcgttggttctcaacgctctcaatgggggctctgttggttctcccgcaacgctactctgtttaccaggtcaggtccggaaggaagcagccaaggcagatgacgcgtgtgccgggatgtggctggcagggcccccacccatttctgcctcccaccgtttcgtcaaaaaatcccaacatggctaaactttaaccacaactgacgtcgcaagaattgtctggctgcgcagtacgcttcggaggtatgtctgatgaagtatgttgatggttttgttgttgccgttcctgccgataaaaaggatgcctatcgggaaatggccgctaaggccgcgccattatttaaagagttcggtgcgcttcgtattgtcgaatgctgggccagcgatgtaccggatggtaaagtgaccgattttcgtatggcggtgaaagcggaagagaatgaagaggttgtctttagctggattgaatacccttcaaaagaggtccgcgacgctgctaatcaaaagatgatgtcggacccacggatgaaagagttcggcgagtccatgccgtttgacggcaagcgaatgatctatggtggattcgaatcaatcatcgacgagtaggtagcgtgacgggctgtgcggcgtgccgtcagccctaaaattcacaaatgttgctcggcccagcgtaagaaatcctctttcggtaatgccttgctgtagagccagccctgaccgtagtgcacgccatgctggcgtagccactcttcttgtttactggtttcgattccctccgcaaccattttcagtttcagtgtttttgccatttcgatgatatgcggcgtgacatttttatattccagcgcatcaacgaaagatttatcgatcttcagaatgtcgacatccagatcctgtaaatagcttaaacttgaataccctgtaccaaaatcatcgagataaatttcatggcccgcctcccggtagcgagaaattatcggggcgctggttttcggatcggcaaactcgcgttcagtgagttcaagcgcgatctgtctgggattaacctgatagtgattgatcatttcacgcagcaattgcgggattttttccgaggtgagcacggtggattcaagattgatcgaaatatgctgctgagaatgctgacgcagccagtcgcccatatcttcaaagacgcttcttataatcagtagcgtcaatggctcagaaaggcccgtttgctgtgccagcggaataaaactatctggtgacaaccaactaccgtctgtctgcggccagcgcgccagtgcctcagcaccgacaattttgccattggctaaggagacaatcggctgatagtgcacgcaaatatcacgattttcgatagcatcctgcagccgatgatgcggtgactggatacggcgcaaaatacgcagcacaaacatcgctgccagcaggccaatcaccaacccgagcggtaaccaaataaagacttgccgatgccagcctttctgcaacattttcgttgaagcccaggtgatgatcgaaatattcatctccggtaagggcaggatatcgtaaatgattccattattttcgatatgctcaccgggtgttttttgtagcctggtaataattccctgagcaattttatcgctgctggttatgacaacgttatgggcattgccaataatggcggcatcaatttgccatgagctatagggaatgacatcaataaaggaagcggggtcgatcatgacgacataatgtgccgttcccatggcgaccatgtaacgaataatgcctaaatcgttatgcgatgttaaccagacacgataaccatctttcgaaattttacctggctcggggaaggtatcgggcgggctttcatgctccagagacgaacattggggaacgttgttatcgatataaaccacttcctgaatatagcgataactgtaagatacccgacgcatttccatgagatgggcttcgctacaggcagcgccttgccatctttccagctcttgcagcgcatctttcccttgtgtcgccaccttattggcccgaatagcgacgcgggaggaatacgtattcagctcttcaataaatgatgtttctacctgctgatgggccagccagatgcttaagccaacaggcagcaatactgaaagaatcagtactcccgaaataaggccgaccagatgtcgtgttctcaccagcatatccttattaacacagtgtagggaaagtatatctgattgtggaaaaaggctggcaggagataaggaggtagagctggtatttcatgaagtgatgggtggaagcgagcgttgtcatttgaccaggcgtagagctttacgcctggtatgtacccctaacttaagatgttgattcggcgcgagcgagggtaaaaatatcgtaaaaagatagttcacctttacggacgatcattttttgcagttgttctttatgaacatccgcgacacgcggagagttcaggatggcttcaaccagcgcggcaggtacaaagcgcgtgttgtaccattcgccgttatagcaaacgcggaaatccagcacgtcgatatcttcatagcggtaacgtgggtagacatcgaaaaagaagaaaccattaagcaggataaataatacaaccagtagccagacagagcctgaaagcgtttcggattgcaacatcaccgccagggtagcaaaaaaagcaacgtacataccgataaacagccccggatgtttacggataaaactgatactaaagcggggtttgttgtcgcgtttttcgcgggtattcagagactcaatcgtttcggtcagcaggcgttgtatttcggtcatcgtttgccttcgtgatatctgcaactttccagggaacaccctattttaacgtgggaatagtagaggggaagtaacagatttgccacgattttgcataacagttgagaaaatctggttacaattttttaatgattctggctggattaccgcccacgacaacgttgtccgggacatcttttgtgacaactgcacctgaggctaccacgacgttatcaccaatggtcacaccagggttaatgactgcacgtccgccaatccagacgttattaccgatggtgacgggtttccccagttcagcaccgctattacgtgctacagggtcgatgggatgtgttgccgtgtagatatgaacgcctggtgccaacatacagttatcaccaatgcgaatagggcagacatcaagcatcacgcaatcgaagttggcgaaaaaattattgccgagaaaaatgttatagccatagtcacagcgaaacgttggctcaatataagcctctgtcacctgaccgaataaatcagcaagaatttgctggcgtaatgtgtgctcttccgccagggaatgattgtatcggtgaataagccgacgagcgcgcaggcgatcgcgagataacgcctcatctgccgagtgatacaactcaccagcaatcatcttttctttttctgtgctcattactgacctccggttgctgaaaatgcggcaacacagtaagacgaaaagtcagtgaagagaacgttcccattacatctgtgtgatgaagatcacatagggtatgtcttcatggcgaaaaaagtgcaaaattcttaataaacagccagttatagctccgaaagcgagttatttattagcgaataaatttccatactgaggaagggatcttgtcgtacagtttattcatggtcaattcggcgaggcggtgatctgcggctgagtaaaataccgccagttcattatctgataattcgtatttatttttctcgataacacgctccagcgtgtcaattgtctggcaacgacgtaaacgcattaaataatcggttttcgttaaaggtttttcggacatacttctacccatggttgtaataattctaacaagataaactcgcaggattctctttcgtcgcattgacaaaacaacggaatagtcgattacctgacttccgccatttctgaagatcctgcatattaataccataactactgaacaacataaaggtgtcatccagatattcgtcgatctgctcaatgagcttattgtcttcattatacttaattttgtaattaagtgcgaaggtcgcaatatgctcaatcagttcattcaactggaggttgatcgccgaggttgggtcgttaacccagccatgattgctttcttcaaggtttgcaaggcagtcatgatacagggtttcacagagaaacttaagctgtgcgatatcatgtcttttgggtgagtattcatccataacgcgtccccttcttagcggttgaactaacggacacctttcgggatggaaaaaacttactgacctggacttgccctctcgtttgttagcttaactataagccactctttgtaggttttcatcgcattattacgaaaaattacaattaggaaggaagcgggacaggactcactttttcatactagcaccaacccgcagcaggtaaaagcagtttgctcgaactgttcataacatttcagaattatcgccagaagaaattggtgacactaataccaggattgctctgaatatgacgtaataaccgaggaatgaataaagaattaccgcaaataattaagaatagcctctaaatggttatggattattaaatctattagcgctacttaatataaattaactaacaatcagtattttttatgaattttatacgtggttaatactggttttcgtatgagatcctgagttggtggttcaatactccttaatgttcgtaggttatgcataaaaaaggccgcttgcgcggccttagtgattacacgttgtatcaatgatgatcgacagtatggctgtgctcgatatcttcattcttgcggctaaagcggcggcgaaccaccacaaagaataccggaacgaagaagattgccagtaccgttgcggtcaccatcccgcccattacaccggtacctactgcgttctgcgcgccggaaccagcaccagtactgataaccagcggcataacgccgaggataaacgccaacgaggtcatcaggattggacgtaaacgcatccgcaccgcatcaagcgtcgcttcaatcagacctttaccttctttatccatcaagtctttggcgaattcgacgataagtatcgcgttcttcgccgacaaaccaatggttgtgagcaggcctacctggaagtaaacgtcattggtcaggccacggaaggtggcagccagcaacgcaccgataacccccagcggaacgaccagcataacggagaacggaatcgaccagctctcgtacagcgcagccagacacaggaacacgacaatcaacgaaatcgcgtacagtgaaggtgcctggttgccggagagacgttcctgataggacattcccgtccagtcatagccaacaccggtaggcagtttgctcgccagttgttccatcagctccattgcttcaccggtacttttacccggtgccgcctggcctaagatttccatagatggcaggccgttgtaacgttccagacgcggcgaaccgtactcccaacgagaagaggagaacgccgagaacggcaccatctgaccatcagcagcacgaacataccagtcgccgatatcatccggcagcatacggtatttcgcttctgacatgacgtaaactttcttcacacgaccgcggtcgataaagtcgttcacatagctaccgccccatgcagcgcccagagtggtgttaatgtcgttgatagaaacacccagcgcctgcgctttttcctggtcgatatcaatcttaaactgcggggtatcttccagaccgtttggacgtacgctggtcaacatatcagggtgcttcgctgcttctgcaagcaactggttacgcgcctgagtcagtttttcgtgaccaaggccagcctggtcaatcagctcaaagtcaaagccggttgcggtacccagttccacgattgcgggcaggttaaaggcgaaaaccatcgcatctttgatttgcgagaaagcacgtgttgcacgcatggtaatcgcttcaactttgttttcttcgcccggacgatcggcccagtccttcaaggaaacgaacgcaataccggtattctgaccacgtcccgcaaagccgaagccgttaacggcgaacaccgactcaacgttgttcttttctttggtcagatagtaattcgttacctcattgagcactttctgcgtacgttcctgcgttgcacctgctggcagctgaaccatggtcataaatacgccctggtcctcatctggcaagaaggagcttggcagacgcacgaacagataggccatgccgaccacgatgatcagatacagcaccaggtagcgccccgtactgcgcagaataccgcctacgctgtcggtgtagtggtgcgtgctcttctcgaacatgcggttaaaccagccgaagaagccttttttaccttccccgtgatcgcctttggcaatcggtttcagcatggtggcacaaagagccggagtcaggatcaacgccaccagtaccgacagcgccattgctgaaacaatggtaatagagaactgacgatagatagcaccagtagaaccgccaaagaaggccatcggtacgaataccgccgacagtaccatcgcgataccgaccagagcgccctgaatctgccccatcgacttacgggtggcttcttttggcggcaaaccctcttccgccatcacacgctcaacgttttctaccacaacgatagcgtcatccaccaacaggccgatggcgagtaccatcccgaacattgttagcgtgtttatcgagaagccaaaggcggcaaggacggcaaaggtcccgagcaataccaccggtacggcaatggtcggaatcaacgtcgcgcggaagttctgcaagaacagatacattaccaggaacacgaggatgatcgcttcgaccagcgttttaaccacttcgtgaatagagattttcacgaacggtgtggtgtcatacgggtaaacaattttcagacccgacgggaagaacggttccatcttcgccagttcagcacggattgccgcagcggtatccagcgcgttcgcaccggtcgccagcttgatccccagaccggaagccggttggccgttaaactctgcgatgatgtcgtagttctcaccacccagctcaattttcgccacatcacgcagtagcacgcgggaaccatcctgattcactttcagcaggattttgccgaactcttcagtagaggtcagacgcgtctgagcaataatagaggcgttaagctgttggcctttcaccggcggcgtaccaccgagctgaccagctgcaacctgggcgttctgtgctttgatggcggtaatgacatcaaccggcgttagctggaatttgttcagttcattcgggttcatccagatacgcatcgcgtactgtgaaccgaacaactgaacgtcacccacgcccgacgtacggctgatggcatctttcatattcgccgccacgtagtcggagatatcctcctgcgtcatggtgccatcggtgttgataacgccgacaaccatcaggaagctgctggatgatttctcaacgctcaccccttgctgctgtacttcttgcggcagcaacggcatcgccagctgcagtttgttctgcacctgaacctgcgcgatatccgcatcagtaccagactcaaaggtcagggtgatctgcacggtacccgtggagtcactgttagaggacatgtacatcaggttatcgataccgttcatattctgttcgataacctgtgtcaccgtgtcctgcactgttttcgcatcagcgccagggtaggaggcggagatcgttactgccggcggtgcaatcgtaggatattgcgccaccggcagtttgaggatcgccagcccccctgccaacatgatgataatggcgatcacccacgcaaaaatcgggcgatcgataaagaaattaggcatgtcttaacggctcctgtttaagttaagacttggactgttcaggctgagcaccgcttgcggcttgctggttattatcagcggtaacttcttgtgcttttacctggacaccaggacgcactttctgcagcccacttattactacgcgatcgcctgctttcagaccttctgtcaccagccacttatcgccgatagcctggcttgcaacgatcggacgggtttccactttgtcatccgcgccaaccaccagtacggtggcatcgccacgcggcgtacgggttacgccctgttgcgggactaaaatagcgtttggattaagcccttcttccagacgtgcacgcacgaacatacccggcagcagagtgtgatccgggttcgggaagatagcgcgtagggtgatagacccagtggtctgatcaacggtaacgtcagagaattccagcgtaccgtcctgcgggaacttaatgccgtcactggtgatcagcgacactttggctttgccgttctcttgtttcagcgtgccattcgccagttcctgtttcaggcgcaggaagtcgttgctggactgggtcacatcaacgtagatcggatcaagttgctgcacggttgccagcgcagtcgcctgaccgttctgtaccaatgcgccttccgtcacgtttgacttaccaatgcgaccactaatcggagaggtgactttggtgtaagccagattgattcgcgaagtttcaacggcagctttcgccgcagttaccgcagcattcgcctgttgcgcatcagccagagcctgatcgtactcttgcttactgatgtactgagtaccgagcaatttctgataacgattcaccgtcaattgcgcgatattggctgcagcctgggctttcgccagatcacctttcgcactgtcgtatgccgcctgataggtcgcaggatcaatctgatagagagagacacctgcttcgatgtcgctaccttctttgaaattacgcttcaggataatcccgctaacttgaggacgaacttctgcgatccggtaggcactggtgcgacccggaagctcggttgtgatctgcagaggttcagttttgactgttactacgccaacggcgggcatctgctggccaccttgttgggcctgtttgtcgtcacatcctgttagggctaagctgcctgagagcatcagaacgaccgccagaggcgtaaaccctctgtttttgttcatatgtaaacctcgagtgtccgatttcaaattggtcaatggtcaaaagttaataaacccattgctgcgtttatattatcgtcgtgctatggtacatacattcacaaatgtatgtaaatctaacgcctgtaaattcacgaacatatggcacgaaaaaccaaacaagaagcgcaagaaacgcgccaacacatcctcgatgtggctctacgtcttttctcacagcagggggtatcatccacctcgctgggtgagattgcaaaagcagctggcgttacgcgcggtgcaatctactggcattttaaagacaagtcggatttgttcagtgagatctgggaactgtcagaatccaatattggtgaactcgagcttgagtatcaggcaaaattccctggcgatccactctcagtattaagagagatattaattcatgttcttgagtccacggtgacagaagaacggcgtcgattattgatggagattatattccacaaatgcgaatttgtcggcgaaatggctgttgtgcaacaggcacaacgtaatctctgtctggaaagttatgaccgtatagaacaaacgttaaaacattgtattgaagcgaaaatgttgcctgcggatttaatgacgcgtcgcgcagcaattattatgcgcggctatatttccggcctgatggaaaactggctctttgccccgcaatcttttgatcttaaaaaagaagcccgcgattacgtcgccatcttactggagatgtatctcctgtgccccacgcttcgtaaccctgccactaacgaataaccctgaatctgactccaggaattttcctggacattttcgtcgttgctattctggttcactgcgtcgtgatattcttgcggtttgactttttcaggtcgttcttcaggttcagaaaccttcattcatcatgactatgttccagtattacaaacgatcacggcattttgttttttcagcatttattgcttttgtttttgtcttgttatgccagaacgcggcgtttgcacgggcgtcatcgaatggtgatttaccgacaaaagcggacctgcaggcacaacttgactcactgaataaacaaaaagatctttctgctcaggacaaactggtgcagcaggatctgacagatacattagccaccctcgataaaatcgatcgcgtaaaagaagagacagttcagctacggcaaaaagtcgctgaagcgccggaaaaaatgcgccaggcgaccgcggcgttaacagcacttagtgatgtcgataacgacgaagaaacgcgcaaaattctgagcacgctttcgttgcgccagctggaaactcgcgttgcccaggcgctggacgatttgcaaaacgcacaaaacgatctggcgtcttataacagccaactggtttcgctacagacgcagcccgaacgcgtacaaaatgcgatgtataacgcttcgcagcagctgcaacaaattcgcagtcgtctggatgggactgatgtcggcgagactgccttacgtcccagccagaaagtgttaatgcaggtccagcagactttgctgaatgccgagattgaccagcagcgtaaaagcctggaagggaacactgtcttgcaggataccttgcaaaagcagcgtgattacgtgacggcgaacagcgcccgtctggagcaccagttacaactgttgcaagaagcggtaaacagcaagcgcctgactttaaccgagaaaacggcgcaggaagctgtctccccggatgaagccgcgcgtattcaggctaatccgctggtgaagcaggaactggaaattaaccagcagttaagtcagcgtctgattaccgcgactgaaaacggtaatcagttgatgcagcaaaacattaaagtcaaaaactggctggagcgtgcgctgcaatcggaacgcaatattaaagagcagattgccgttctgaagggcagtctgctgttgtcacgtatcctgtaccagcaacaacaaacactcccctcggcagatgaactggaaaacatgaccaaccgcatcgcggatttgcgtctcgaacagtttgaagtcaaccagcagcgtgacgcgctgttccagagcgatgcgttcgtcagcaaactggaagaaggtcacaccaacgaagtcaacagcgaagttcacgatgcattattgcaagtagttgatatgcgtcgcgaattgctggatcagcttaacaaacagttgggtaaccagctgatgatggccattaacctgcaaatcaaccagcagcagttaatgagtgtgtcgaaaaacctgaaatccatcctgacgcagcaaattttttgggtgaacagtaaccgcccgatggactgggactggattaaagcgttcccgcaaacgctgaaagatgaatttaagtcgatgaaaatcacggtgaactgggaaaaagcctggcccgccgtattcatcgccttcctcgctggtttgccgctgctgttgattgccgggttgatccactggcgtctgggctggctgaaagcgtatcaacaaaaactggcttccgctgtgggttccctgcgtaacgacagccagctcaacacaccaaaagcgatccttatcgacctgatccgcgcactgccggtgtgcctgattattctcgctgtcggcctgattctgctgactatgcagctcaatatcagcgagttattgtggtcgttcagcaaaaaactggcgattttctggctggtatttggcctgtgctggaaagtgctggagaaaaatggtgttgccgtgcgtcactttggtatgccggaacagcagaccagccactggcgtcggcaaattgtccgcatcagcctcgcgttgctgccgatccatttctggtctgtggtggcagaactctccccgctgcatctgatggatgatgtgctggggcaggcgatgattttcttcaacctgctgctgattgccttcctggtgtggccgatgtgccgcgaaagctggcgtgataaagagtcgcacaccatgcgactggtcaccattaccgtgctgtcgattatcccgattgcgttgatggtgctgaccgccacgggttacttctacaccacgctgcgcctctccgggcgttggattgaaaccgtttatttggtgatcatctggaacctgctgtaccagacggtattgcgcggcttaagcgtagcggcgcggcgtatcgcctggcgtcgtgcactggcgcgtcggcagaatctggtgaaagagggcgcagaaggtgccgaaccgccggaagaacccaccattgcgctggagcaggttaaccagcagacgctgcgtattaccatgttgttgatgtttgcgctgttcggtgtcatgttctgggcaatttggtctgatttgatcaccgtgttcagctatctcgacagcattacgctctggcattacaacgctactgaagctggtgctgcggtggtgaaaaacgtcaccatgggcagtctgttgtttgcgattatcgcctcaatggtggcctgggcgttgattcgcaacctgcctggtttgctggaagtgctggtgctctcgcgactgaatatgcgccagggcgcgtcgtatgccattactaccatccttaactacatcattattgccgttggtgcgatggcggtgttcggatcgctgggcgtctcgtgggataaactccagtggctggcggcagcattatccgtaggtcttggttttggtttacaagagatcttcggtaacttcgtttccggtttgatcattctgttcgaacgtccggtgcgcataggcgacacggtaaccattggtagcttctcgggtacggtcagcaagatccgtattcgtgcgacaacgattaccgatttcgatcgcaaagaagtgattatcccgaacaaagcgtttgttaccgagcgtctgatcaactggtcgttgactgacacgactacgcgtctggtgatccgtctcggcgtagcttatggctccgatctggaaaaagtgcgtaaagtgttgctgaaggcggcgactgagcacccaagggtgatgcacgaaccaatgccggaagtcttctttacggcatttggtgccagcacgttggatcatgagctgcgtctgtatgtgcgtgaactgcgtgaccgtagccgtactgtcgatgagctgaaccgtactatcgatcagctgtgccgtgaaaacgacatcaacattgcctttaaccagcttgaagtgcatctgcacaacgagaagggcgatgaggtgacggaagtcaaacgcgactacaaaggcgacgatccgacgccagcggtagggtaataaccaaagggggcgacatttagttgccccgagattactaacaaagtgcgcgttgttcatgccggatgcggcgtgaccgccttatccggcctacgaaactgcaagaattcaatatattgcaggagcggtgtaggcctgataagcgtagcgcatcaggcagttttgcgtttgcccacaatcttaggggacatttagcggccccatttatttctcacttttccgcctcatcatcgcgcgttaatttcttttcataatcgcgttttacaatatccagcgcgcgcagcacggtgcgggctgggatctgattttcttccagtagcacaatcaaatcgacggccagtttgacatcgtcaggggcattttccagtgacatactctctccattgctagcgggttaaacgcgctaacctgttttcgattttttccagcgcatggcggcagcgtgccaggcgcgcttcataggcttccacttcacgatgcagcgtctgctgttccacgagatcggtcgctcgtgccagacgggctctacgttcggcaaccatctcacgtagccgccgctcaaaatcctgatgctgaatacgtttacgctgccagcgggcaattttcggtggtgcgctatcccactcgcgtagcgaccaggctgtggcttcacgcgctatagcctccagttgcgccgccagatgttctgccagccaggcgacttgcggcagctgttgctgctcaaccgcatgacgaagcgcagccaggttatcgcccgcctcatcgagacaagcctgtagtgttgtcgcacgggtctgaaaaaggtgcctgtcaaaacgggcacttagcgtggcaaattgcgctaccggggcacaacgctgacgcagcgtggcgagctgtccttccagtttttccagcagcagggcggttttcacgataagacctcaatgaaaatgataattgttatgctaaagtagccactctgtaagctgacaacactcaatatgcaacgaatcattttaatcatcattggctggctggcggtagtgctgggtacgctgggcgtggtattaccggtattaccgacgacgccgtttatcctgctggcggcctggtgctttgcccgttcttccccgcgctttcacgcctggttgctgtaccgctcatggtttggcagctatctacgtttctggcagaaacatcatgcgatgccgcgcggcgcaaaaccacgggcgattttgcttattttgattacgtttacgatttcgctgtggttcgtccagatgccgtgggtgcgcatcatgttgctggtaattctcgcctgtttgcttttttatatgtggcgaattccggtgattgatgaaaagcaagaaaagcactgaagcacaacaatcgcagttgcaattattgcgtacagccagtacattctggcgttttcgagcacaggcgcaggcggtcaaaggttaaacaactgttacttttgatacgttcaaaacgcgccgtgagtaccaccgtaacaagcaggcatacacttatgaccgcgactgcacagcagcttgagtatctcaaaaatagcatcaaaagcattcaggactacccaaaacccggcattcttttccgcgatgtcaccagcttactggaagacccgaaagcttacgctctcagcatcgacttgctggttgagcgttacaaaaatgcgggcattaccaaagtggtcggcaccgaagcgcgtggcttcttgtttggcgctccggtagctctgggtctgggcgttggctttgtaccggtccgtaaaccgggcaaactgccgcgtgaaaccatcagtgaaacttacgacctggaatacggcaccgatcagctggaaatccacgttgatgccatcaaaccgggcgataaagttctggtggtggacgatctgctggcaaccggcggcactatcgaagcgaccgttaaactgatccgtcgtctgggtggtgaagtagctgacgctgcgttcattatcaacctgttcgatctcggcggcgaacagcgtctcgaaaaacagggcattaccagctacagccttgtcccgttcccgggccattaattatcgtcagtcttgcgctgctcacgctacgggcagggcaagatgtgcattcagcctcgccgttctgacggggctgtgttagcattaccccttcgtgaatccaccttccagcgtttcagagcctgccaatgagttatcaggtcttagcccgaaaatggcgcccacaaacctttgctgacgtcgtcggccaggaacatgtgctgaccgcactggcgaacggcttgtcgttagggcgtattcatcatgcttatcttttttccggcacccgtggcgtcggaaaaacctctatcgcccgactgttggcgaaggggctaaactgcgaaaccggcattaccgcgacgccgtgcggcgtgtgcgataactgtcgtgaaatcgagcaggggcgctttgtcgatctgattgaaatcgacgccgcctcgcgcactaaagtcgaagatacccgcgacctgctggataacgttcagtacgctccggcgcgtggtcgtttcaaagtttatctcatcgacgaagtgcatatgctgtcgcgtcacagctttaacgcactgttaaaaacccttgaagagccgccagagcacgttaagtttttgctggcgacgaccgatccgcagaaattgccggtgacgattttgtcacgctgtctgcaatttcatctcaaggcgctggatgtcgagcaaatccgccatcaacttgagcacatcctcaatgaagaacatatcgctcacgagccgcgggcgctgcaattgttggcacgcgccgctgaaggcagcctgcgagatgccttaagtctgaccgaccaggcgattgccagcggtgacggccaggtttcaacccaggcggtcagtgcgatgctgggtacgcttgacgacgatcaggcgttatcgctggttgaagcgatggtcgaggccaacggcgagcgcgtaatggcgctaattaatgaagctgctgcccgtggtatcgagtgggaagcgttgctggtggaaatgctcggtctgttgcatcgtattgcgatggtacaactttcgcctgctgctcttggcaacgacatggccgccattgagctgcggatgcgtgaactggcgcgcaccataccgccgacggatattcagctttactatcagacgctgttgattggtcgcaaagaattaccgtatgcgccagaccgccgtatgggtgttgagatgacgctgctgcgcgcgctggcgttccatccgcgtatgcctctgcctgagccagaagtgccacgccagtcctttgcgcccgttgcgccaacggcagtaatgacgccaacacaggtgccgccgcaaccgcaatcagcgccgcagcaggcaccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgcccggtgccatcggcgctggaaaaagcgccagccaaaaaagaagcgtatcgctggaaggcgaccactccagtgatgcagcaaaaagaagtggtcgccacgccgaaggcgctgaaaaaagcgctggaacatgaaaaaacgccggaactggcggcgaagctggcggcagaagccattgagcgcgacccgtgggcggctcaggtgagtcaactttcgctaccaaaactggtcgaacaggtggcgttaaatgcctggaaagaggagagcgacaacgcagtatgtctgcatttgcgctcctctcagcggcatttgaacaaccgcggcgcacagcaaaaactggctgaagcgttgagcacgttaaaaggttcaacggttgaactgactatcgttgaagatgataatcccgcggtgcgtacgccgctggaatggcgtcaggcgatatacgaagaaaaacttgcgcaggcgcgcgagtccattattgcggataataatattcagaccctgcgtcgattcttcgatgcggagctggatgaagaaagtatccgccccatttgatcgtaagcacagcttacgttcgtcatccttaacgtgattgagagagaaacctatgtttggtaaaggcggtctgggtaacctgatgaagcaagcccagcagatgcaagaaaaaatgcagaaaatgcaggaagagatcgcgcagctggaagtcaccggcgaatctggcgcaggtctggtaaaagtgaccatcaacggtgcacacaactgccgtcgcgtagagatcgacccgagcctgctggaagacgacaaagagatgctggaagacctggtggctgcagcattcaacgacgcagcacgtcgtattgaagaaacgcagaaagaaaaaatggcctctgtatcctccggaatgcagctgccgcctggctttaagatgccgttctgatgcaaaccagcccgctgttaacacagcttatggaagcactgcgctgtctgccgggcgttggcccgaagtcggcgcagcgtatggcgttcacgctgcttcagcgcgatcgtagcggcgggatgcgtctggcgcaggcgctcacccgggcgatgtcggaaatcggccactgcgccgattgccgcaccttcaccgaacaggaagtctgtaacatctgttcgaatccacgtcgtcaggaaaacggtcaaatctgcgtggtggagagtccggcggacatttacgccattgagcagacggggcagttttcaggtcgttattttgtgttgatggggcacctgtcaccgctggacggcatcggtccggatgatatcgggcttgatcgtctggaacagcgtctggcagaggaaaaaatcactgaagtgatcctcgccaccaaccccacggttgaaggtgaagctaccgctaactacattgccgagctttgtgcgcaatatgacgtggaagccagccgaatcgctcatggcgtaccggttggcggcgaactggaaatggtcgatggcaccacgctgtcacactcccttgccgggcgtcataagattcgtttttaagcaaacgagagcaggatcacctgctctcgcttgaaattattctcccttgtccccatctctccctcatcctgtttttaaccttaaaatggcattattgaggtagacctacatgaaaggacaagaaactcgtggttttcagtcagaagtgaaacagcttctgcacctgatgatccattctctctattccaataaagaaatcttcctgcgtgagcttatctctaacgcctccgatgcggcggacaagctgcgtttccgcgcgctttctaacccggacctgtacgaaggtgatggtgaactacgcgttcgtgtctctttcgataaagacaagcgcacgctgaccatctccgataacggcgtggggatgacccgcgacgaagtgattgaccatctggggactatcgctaaatccggcaccaaatcattcctcgaatccctgggttctgaccaggcgaaagacagccagctgatcggtcagtttggtgttggtttctactctgcgtttatcgtggctgacaaagtgaccgtgcgtactcgcgcggcaggcgaaaaaccagaaaacggcgtcttctgggaatcggctggcgaaggtgaatacactgttgccgacatcaccaaagaagatcgtggtactgaaatcaccctgcatctgcgtgaaggcgaagacgagttcctcgatgactggcgtgtgcgttccatcatcagcaaatattccgaccatatcgcgctgccggtagagatcgaaaaacgcgaagagaaagacggcgaaaccattatctcctgggagaaaatcaacaaagcgcaggcgctgtggactcgtaacaagtcggaaatcacagatgaagagtacaaagagttctacaaacacatcgcccacgactttaacgatccgctgacctggagccacaaccgcgttgaaggtaagcaggagtacaccagcctgctgtacattccgtctcaggcaccgtgggatatgtggaaccgcgatcataaacacggtctgaaactgtatgttcagcgtgtgttcatcatggacgacgcagaacagttcatgccgaactatctgcgcttcgtgcgtggtctgattgactccagcgatctgccgctgaacgtttcccgtgaaatcctccaggacagcacgttaacgcgtaacctgcgcaatgcgctgaccaagcgtgtgctgcaaatgctggaaaaactggcgaaagacgacgcggaaaaataccagaccttctggcaacagtttggcctggtactgaaagaaggtccggcggaagatttcgctaaccaggaagcgatcgccaaactgctgcgttttgcttctacccataccgattcttctgcgcagaccgtgtctctggaagactacgtttcccgcatgaaagaagggcaggagaaaatctactatatcaccgcagacagttacgcggcagcgaagagcagcccgcacctggaactgctgcgtaagaaaggcatcgaagttctgctgctttccgaccgcatcgatgagtggatgatgaactatctgactgagttcgacggtaaaccgttccagtctgtgtctaaagttgacgagtcgctggaaaaactggctgacgaagttgatgagagcgcgaaagaagcggagaaagcactgactccgttcatcgaccgtgtgaaagccctgctcggcgagcgcgtgaaagatgtccgtctgactcaccgtctgaccgatacgccagcgatcgtttcgaccgacgcggacgaaatgagcactcagatggcgaaactgttcgctgcggcgggccagaaagtgccagaagtgaaatacatcttcgaactgaacccggatcacgtactggtgaaacgtgcggcggatactgaagatgaagcgaagttcagcgagtgggtagaactgctgctggatcaggcgctgctggcagaacgcggcacgctggaagatccgaacctgtttattcgtcgtatgaaccagctgctggtttcctgatgtcatgccggatgaccttcgtgtcatccggcatttttcttttcttcatctgcactttccgcaaattatcttgccattaaccgtttcagcctcaggtgcctttcttgaggcaatcgcctgttggtggtatcgtttatcgctttttcaaaaaattcgacacattttaaggggattttcgcaatgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgcaacggtttcctgttggacggcttcccgcgtaccattccgcaggcagacgcgatgaaagaagcgggcatcaatgttgattacgttctggaattcgacgtaccggacgaactgattgttgaccgtatcgtaggccgccgcgttcacgcgccgtctggtcgtgtttatcacgttaaattcaatccgccgaaagtagaaggcaaagacgacgttaccggtgaagaactgactacccgtaaagacgatcaggaagagaccgtacgtaaacgtctggttgaataccatcagatgactgcaccgctgatcggctactactccaaagaagcggaagcgggtaacaccaaatacgcgaaagttgacggcaccaagccggtggctgaagttcgcgcagctctggaaaaaattctcggctaatcaagccgcagcagatctgctttcgggcaggtctgctcatcctcctcaggcaatacctcttacagcaattagttcttcttcttcacttttccgctacaattatcaacaagttgaatcgataagaggcggtaatgcgtcagactaaaaccggtatcctgctggcaaacctgggcacgcccgatgcccccacacctgaagcggtaaaacgctatctgaaacaatttttaagcgacagacgcgtggttgatacctcacggttgttatggtggccgttgctgcgcggcgtgattttgccgctgcgttcgccgcgtgtggcgaagctgtatgcctctgtctggatggaaggtggctcgccgctgatggtttacagccgccagcaacagcaggcgctggcgcaacgtttaccggagacgcccgtggcgctgggaatgagctacggctcgccatcactggaaagcgccgtagatgaacttctggcagagcatgtagatcatattgtggtgctgccgctttatccgcaatactcctgttcaacggtcggtgcggtatgggatgaactggcacgcattctggcgcgcaaacgtagcattccggggatatcgtttattcgtgattacgccgataaccacgattatattaatgcactggcgaacagcgtacgtgcttcttttgccaaacatggcgaaccggatctgctgttgctctcttatcatggcattccccagcgttatgcagatgaaggcgatgattacccgcaacgttgccgcacaacaactcgcgaactcgcttccgcactggagatggcaccggaaaaagtgatgatgacctttcagtcgcgctttggtcgggaaccctggctgatgccttataccgacgaaacgctgaaaatgctcggagaaaaaggcgtgggtcatattcaggtgatgtgcccgggctttgctgcggattgtctggagacgctggaagagattgccgagcaaaaccgtgaagtcttcctcggcgctggcgggaaaaaatacgaatatattccggcgcttaatgccacgccggaacatatcgaaatgatggctaatcttgttgccgcgtatcgctaaagctgagcggtaaagaactgagcgccgtcgcgaagagcctcgtcggcggttttcatcatccgtgaataatgcaaaaaggcgtgcagcgtgcctgggtagagtttgaactcacagggctgctgatgcgccgctaacgtctggtaaagcagacggctgtcatccagcagtggatcgaactccgccccggcaataaaacagggcggaacttcgcgagtgagatcattattaaacaggcagtaatatggcgactcgcggtccgcgtcgttgcttaaatacgcctcttcatacatctgcaaatcctgttgcgttaagccatcccagacaccacccaacagacgacgagtcacggaatcccgtaatccgtaaagcccataccacagcaaaacgcccgcaactttaccgcaatcgatctgtttatcgcgcaaccacaacgcactggcgagcgccagcatggcacctgcggaatcaccggcaaaaccaatgcgggacatattgatttgataatcctccgcctgctggtggaaataacaacaggcagccacaatttcctctatcgcttgcggaaaacgcgcttcaggtgaaagggtgtaatcaatgccaatcaccgtacattggctgtagcttgccagcaggcgcatgatgcgatcgtgggtatcgagattgccgagaataaaaccgcctccatgcaaataaaatagcgtcgccgggctatctggctgcggataaaagatacgtgttttcacctgcccatattttgttggaaccctgtaagctctggttgccatttctggagcgctcacattccagaatcggcgctcaagcgtgtaatactgtcgttgctcagcaatcgttcccgttgcaggccagggcggtaaatccggctgaagagtattcacaacggtcttcatttcagcagagataaggtccagaacgggtaatttgttttccggcttcatgcaaaaactcctttcaaattacgtcattgtaaggaaccactgccatgaaaatgcgatcccgcctgctgatattgaaactggctgcgtctcgcgcgctcccgtcagattgtgttaacattcgccgctcagttaaccacccgtaaaaacaaccatgaaatttcccggtaaacgtaaatccaaacattacttccccgtaaatgcacgcgatccgctgcttcagcaattccagccagaaaacgaaaccagcgccgcctgggtagtgggtatcgatcaaacgctggtcgatattgaagcgaaagtggatgatgaattcattgagcgttatggattaagcgccgggcattcattggtgattgaggatgacgttgccgaagcgctttatcaggaactaaaacagaaaaacctgattacccatcagtttgcgggtggcaccattggtaacaccatgcacaactactcggtgctcgcggacgaccgttcggtgctgctgggcgtcatgtgcagcaatattgaaattggcagctatgcctatcgttacctgtgtaacacctccagccgtaccgatcttaactatctacaaggcgtggatggcccaattggtcgttgctttacgctgattggcgagtccggggaacgtacctttgctatcagccccggccacatgaaccagctgcgggctgaaagtattccggaagatgtgattgccggagcctcggcactggttctcacctcttatctggtgcgttgcaagccgggtgaacccatgccggaagcaaccatgaaagccattgagtacgcgaagaaatataacgtaccggtggtgctgacgctgggcaccaagtttgtcattgccgagaatccgcagtggtggcagcaattcctcaaagaccacgtctctatccttgcgatgaacgaagatgaagccgaagcgttgaccggagaaagcgatccgttgttggcatctgacaaggcgctggactgggtagatctggtgctgtgcaccgccgggccaatcggcttgtatatggcaggctttaccgaagacgaagcgaaacgtaaaacccagcatccgctgctgccgggtgctatagcggaatttaaccagtatgagtttagccgcgccatgcgccacaaggattgccagaatccgctgcgtgtctattcgcacattgcgccgtatatgggcgggccggaaaaaatcatgaacactaacggagcaggggatggcgcattggcagcgttgctgcatgacattaccgccaacagctaccaccgtagcaacgtaccaaactccagcaaacataaattcacctggttaacttattcatcgttagcgcaggtgtgtaaatatgctaaccgtgtgagctatcaggtactgaaccagcattcacctcgtttaacgcgcggcttgccggagcgtgaagacagcctggaagagtcttactgggatcgttaagttatcgtcggttcgtaggccagataaggcgttcacgccgcatctggcattttgctttcaatgcctgatgcgacgctggcgcgtcttatcaggcctacatatccgcgcctattatccggcaaccaccgtttaccccgtcaccacctcacccgccggtggcgtttccagcagttccagcatagtacgggcaatttcacgctcacccatcactacctgattcgcaccacgttcggtgatatacgccacttcatcgtcataatgggcgcgggcaataatctcaatatccggatttttcgcgcgggcagatgccacaatctcgcccgcttcatagccgttgggaatcgtcaggatcagccattttgcacattccagatgcgccagttgcataatttcttcgttcgccgcattgcccaatactgcgcggaccccgcgctcgcgcagctcatcaacacgggttcgtgacgtctcaatcaccaccagcggaatatcagaggcgagcaatttctcccccagcaggctgcctacacggccgtaacccaccagtagcgcatggttgcaaatatccactgggatctgcttctcttcttcgattgcctcttccagcgtctgctcttccagcgtttcggtcttcgccagatatttttccagtagtgcgaacagtaccgggttgagcataatcgacaggatcgcccctgccagtaccaggttttgtccggcctgcggcagtaaatttaatgccattcctagtcccgccaggataaacgcgaactcaccaatctgcgccaggctggcggcgatggttaatgccgtgcgctgggagtgaccaaacaaacgcacaaggaacagggccgcgaccgatttaccaaacagaataattgccagcgtcgccagtactgccagcggttgctgaatcagaattaacggatcaaacaacatcccgacggagacaaaaaacagcaccgcaaacgcgtcgcgcaatggcagtgtatcgtgggcggcacggtgactcagttcagactcgttcagtaccatcccggcaaagaacgcaccgagtgcaaaggagacatcaaacagctctaccgcaccaaaggcaatccctaacgccagcgccagcaccgacagggtaaacagctcgcgggaaccggttgctgcgctgcgtgccataatccacggcaccagacggcgacctaccagcatcataatggcgataaatgcgatcaccttgccgatggtgatccccatatcgactgcaagagtggcaaagcccacatcgccctgttccataattcctgctaccgcgggtagcaataccagtgtcaggaccatcaccaggtcttccacaatcaaccaaccgatggcgatttgcccacgctgactgtcaattaattgccgttcttcaagtgcgcgcagtaacaccacggtactggcggtggaaagacataagccgaacacgataccggtcattaacgaccagcccagcacggcggagagcgccatacccagcagcgtcgccacggctatctgggcgatcgcgccgggaatggcgatggactttaccgccatcaaatccttgagcgaaaaatgcaaaccgacgccgaacatcagcaaaataacgcccagttcagccagttccggcgcaagcttggtatcggcaacaaagcccggagtgaatggtcctgccagcacacccgctaacagatatcccaccagaggagaaatacgtagtttattggccagcatgccgaggataaaggcgagcacaaggccgccaacaatggtggtgataagcggggtggcgtgatgcattccgtctccttttcctggtggttattgtccatttttggccgggaaaaccaaaattacaggtaatagtttatgacaatttcattgatgatgtttatgaataattgttgaattttgcagaaaaatggaattagctgcaaaaaaagcacggatcggaaaacagaaggcggtttaacagaggaaaggcttatggcgactgtaaaacgatgcagccaaagtttgcctttggctgcaatgaaatcagtctttatgccggttatcaggcaggaatatggtcaacatccccaatagtggcaggaaagcacagattttatagactaactctatgctggtgtggtcggcgataagccccagaactgccgcccccagacctcccatgccgaaagcaaaaccgaaaaacagtccagaaactataccgatacgtcccggaagcagctcctgggcgtagaccagaatggcagagaatgctgaagcgaggataaatccaataatcaccgttaaaacccccgtccagtgcaggctggcgtagggtaaaatcagcgtaaacggcgcaacgccgaggatagagccccaaatcacatatttccgtccaattttatcccctacaggcccgccaatcaccgtacctgccgcaacggcaaacaggaaggcaaacaaatgaagctgagcattctggatagataatccgaatttttgcatcagataaaaggtgtaatagctgctgatgctcgccatatagaaatatttcgagaaaatgaggattaacagaatgctgaccgccagaacaactttattgcgcggcagtggattgataatcgtcgctttgggttttcctttattcattcggtgctgtgccgagtaccaacggctgatttgcgccaacaccacgatcgccagcagtgccgcaagcacaaaccaggcaacgttgcctttgccataaggcgcgataatcaccgccgccagcaaggggcccagggaactgccaaagttgccgccgacctgaaagatagattgcgccaggccatgacgcccgccggaagccatacgggccacgcgagaagattccggatgaaagaccgatgaaccggtaccgaccagcgccgctgccagcagaactgcgccaaaactgcccgccagcgccagcagcaccagaccacttaaggtaaagcacatgccaatcggcaacgaccacggcatcggatatttatcggtccagtagccgaccaccggttgcagtagcgaagaggcgagctggaaggtgagggttatcatgccaatctgcataaatgtcagagaaaattctgactgaagcagtggataaatcgccagaatcagcgattggatcatgtcgttcagcagatgtgagaggctgatagcacctaaaataccaaacgatgttcgggccttagtcgttgacgcagccgcgcccgccacaggctgggtttgttcactcattgccataggaaagtcactttttcagggttgcgatgtaaagaatgatcttatttgtgattattacccgactaacatacctgtatgcgccgcctgaaggaagtctcaacacggaatacagaatttctaatctggatgcagatttatcttcaccggacgcagacttgtttatgatgtcgcgtcatactatttttcaacacgttgaaatcagatcagggagagaagtatgaaattattgcagcggggcgtggcgttagcactgttaaccacatttacactggcgagtgaaactgctctggcgtacgagcaggataaaacctacaaaattacagttctgcacaccaatgatcatcatgggcatttttggcgcaatgaatatggtgaatatggtctggcggcgcaaaaaacgctggtggatggtatccgcaaagaggttgcggctgaaggcggtagcgtgctgctactttccggtggcgacattaacactggcgtgcccgagtccgacttacaggatgccgaacctgattttcgcggtatgaatctggtgggctatgacgcgatggcgatcggtaatcatgaatttgataacccgctcaccgtattacgccagcaggaaaagtgggctaagttcccgttgctttccgccaatatctaccagaaaagtaccggcgagcgcctgtttaaaccatgggcgctgtttaagcgtcaggatctgaaaattgccgttattggcctgacgacggatgacacagccaaaattggtaatccggaatatttcactgatatcgaatttcgtaagcccgctgatgaagcgaagctggtgattcaggagctgcaacagacagaaaagccagacattattatcgcggcgacccatatggggcattacgacaatggtgagcacggctctaacgcaccgggcgatgtggagatggcacgcgcgctgcctgccggatcgctggcgatgatcgtcggtggtcactcgcaagatccggtctgtatggcggcagaaaacaaaaaacaggtcgattacgtgccgggtacgccatgcaaaccggatcaacaaaacggcatctggattgtgcaggcgcatgagtggggcaaatacgtgggacgggctgattttgagtttcgtaatggcgaaatgaaaatggttaactaccagctgattccggtgaacctgaagaagaaagtgacctgggaagacgggaaaagcgagcgcgtgctgtacacccctgaaatcgctgaaaaccagcaaatgatctcgctgttatcaccgttccagaacaaaggcaaagcgcagctggaagtgaaaataggcgaaaccaatggtcgtctggaaggcgatcgtgacaaagtgcgttttgtacagaccaatatggggcggttgattctggcagcacaaatggatcgcactggtgccgactttgcggtgatgagcggaggcggaattcgtgattctatcgaagcaggtgatatcagctataaaaacgtactgaaagtgcagccattcggcaatgtggtggtgtatgccgacatgaccggtaaagaggtgattgattacttgaccgccgtcgcgcagatgaagccagattcaggtgcctacccgcaatttgccaacgttagctttgtggcgaaagacggtaaactgaacgacctgaaaatcaaaggcgaaccggtcgatccggcgaaaacttaccgcatggcgacattaaacttcaatgccaccggcggggatggctatccgcgccttgataacaaaccgggctatgtgaataccggctttattgatgccgaagtgctgaaagcgtatatccagaaaagctcgccgctggatgtgagtgtttatgaaccgaaaggtgaggtgagctggcagtaatccgaaagtgccggatgttcgcatccggcacaatgcttaatcgcgacgggcgatatcagcaaatttggcatcgagtatctttgccaggtcgcttgccgccagttcgatatccagaccgcgcttgccgccggaaacataaatagtggcaaattcttgtgcgggggcgtcgataatcgttggcagacgttttttctgccccagtgggctaatccctccaaccagatatcccgtcgaacgctgcgcgaccatcggatcggccatctcaactttcttggcacccagcgcttttgctacttttttaagatccagttgacctgcgaccggcgtaacggccacggcaaggtgtttcatatcaccgttcactgcgaccagcagcgttttgtagacctgatccggattcaaacctaattttttgacgacttcatcgccaaaattggtttcagccggatcgtgctcgtaggtatggatttgaaacgaaatcttgtttttttcgagtaatttaactgcgggtgtcatggtaattttcctgccttaaacaaaaaaacgaagcaagcatacgcctgatggcggtccaaaaaaaagagtcatcttgcctaagagtattggcaggatggtgagattgagcgacaatcgagttacaccgtcgcttaaagtgacggcataataataaaaaaatgaaattcctctttgacgggccaatagcgatattggccatttttttagcgcaacatctgcggcaaattcccttctccatacaggtgtagtgcaccgactgcgaccacatagcgccccggcggcatggcgcgtaatttatcccgccaggcgagatttcgctgatgcatcagcacatcgtacagcgactgactgaacgtattgggcagcgttatttcattattttgcggcggcgcattcaaccaccagctcatcatttgttgcagcaaccgtgcattggtgtgccagtgggtcagcgtgtcgtccagcagcgccagtcctttgtcagggagctggagcaacatggcaatctggttttcagccccttccagttcaatcacgggtttatgttgttgcttcgccgcctgcaatagctggtaatcgataccgtattctgcccgcagccccagtttttgtgcctgcgtcgcctgaagaaccatcgcgatttgccacaacggttgggtagaaaagagcgacggagaaatgcccatctcctggctaatgtgctgcaggttttggagttgctcctcgctaatgcgctcttccagtgcctcgcaggcaggcaaattggcaaaaggcgtatcgctggtggaaacatccgcctcgacgatcagcgcatcggcgtttttgagctttttgagcaaacgggtgggcaggggagccatatcgtggctacccatatgaatactgccaatcagatgaaaatggcgattgccgggaagagtgatatcgatagcaggccaggtgtaatgattaccgcgcagcgcggcccaaagcgtttttacccggtacaacagatccatacgacctccctttgtgaaatatcatgctagcgcgcggggagggatggcgcaaatggagttgattgttgcacttgagcacagtgcttgtgtgcattacaatgattgaataatggacaaggagatgagagaggaatggctcaaaagaaaaatataaggagttttcgtgatgcctggttggctgatttttttgtccattcaacgccacatcgaaagatccctgctgaaatccataccacgttatcacgaaagttggacatcattaatgctgccacttctcattgggatttacgctcccctccggggaaccgatacgaagagttatccgggaaattacaggaatactcctccattagagtgaataaacagtaccgactgatttttaaatgggttaatggcaaggccgaagaattgtttttagacccacacaactactaaaacatagctgtcgtattgacgagaaaggtaaaactatgaaacaggcaacaagaaaaccgacgacacccggagatattcttctctatgaatatctggaaccgctcgatttgaaaatcaatgagttagcagagttgctgcatgttcatcgtaatagcgtcagtgcactgatcaataacaatcgtaaactcaccactgagatggcattccgtctggcgaaagtttttgataccacagtcgatttttggctaaacctccaggcggcagttgatctttgggaagttgaaaacaacatgcgtacccaggaagaattgggacggattgaaacagtggctgaatatttggcacgccgtgaagagcgtgcaaaaaaggtcgcgtagaataatttccctataacggatgcgccaccctaaagcagcgcatccgcaatgatgtacttattccttcggtttaaaccgcagcaatcggttggcgttactcactacggtgatcgacgagagcgccattgccgctccggcaaccaccgggttaagcagtgttccagtgaacggccacaaaataccggcggcgaccggaataccaatgctgttgtagataaacgcaccgagcaggttctgcttcatgttgcgcagcgttgcgcgggaaattgcgagcgcatccgcaacacccatcaggctatggtgcatcagggtaatcgccgcggtttcaatggcaacatcactgccgccacccatcgcaataccgacatccgcctgagccagcgctggcgcatcgttaatgccgtcgcccaccattgctacctgacgtccttcactttgcagacgtttgatcgcttcggctttaccgtccggcagcacgccggctatcacctcatcaatccctgcttctttagcgatcgcattggcggtggtcgggttatccccggttagcatcaccaggcgatatcccgctttatgcaggcgttgcagcgccgccacgctatcactacgcaatggatcgcgtacagccagcagggctaccgctttcccgtcaaccgccagcagcacaggcgttgccccttgcgatgcctgagctgaaatatctgcttcaattgctttggtatcgacctgttggtcatttaacagtgcctgattgcccagcaataacgcatgaccttcagcttcaccgctcacgcccagcccgcgcaatgtgcggaaaccgttgacctgcggtagctgcatatcacctgctttatcgaggatcgctcgtgccagcggatggctggaaccttgctccagcgccgccgccagacgcaatgcttgcgcttcatcaatatcagcaaatgtttttactgcgacaacctgcggcttcccttcggtcagcgtcccggttttatcgaacactacggtatcgagcgtactggcgcgttgcagcgcgtcggcgtcccgtaccagcacgccaaactcagccgcccgcccgacgcccgaaataatcgacatcggcgtcgccagccccagcgcacacggacaggcaataatcagcaccgtggtggcaatcaccagggtatagacaatctgcggtgccggaccaaagaaataccagattgccgcactgatcagcgcaatcaccaccactaccggcacaaatacggctgagattttatccgccagctgaccgatttctggcttactgctctgggcctggcgcaccatacgaataatccgcgacagcgtagtatggctgccaaccgcactggcgcgaaacagcacgctaccgtcctgcaccactgtcccggcatggacgctatcgccttcgcctttttgctgcgggataggttcgcccgtcagcatcgcttcatccagccacgcttcgccttgagtaatctcaccatctaccggcacacggtcgccggtcgtcaggcgcagtaacatacctggctgaacatctgccagcggcacgtttttttcaccttcgtcggtgaccaggcgcgccgtcggtggggttaaatcgagtaatttctccagcgccttagaagaacgctgacgcgcgcgcgcttccagcatatggccgagattgatcagaccgataatcatcgcgctggcttcgtaataaagatgtcgcgcttccatcgggaaccactgcggccacaggttgacgctcatcgaatagagccacgccacgccagtacccagcgccaccagcgtatccatcgtcgctgcaccgttcagcaggcttttccatgcgctgcggtaaaaatgcccgccggcgaaaaccattaccgccagggttatcaggccgataaccaaccacaggctgcggttgtcggcggtgaccatcatgttatcgccgatcatcccccagaccatcaccgggatacccaccgccagtgcgacaatcgcctgccagcggaagcgcttcatcgtagcgacggcggtttcttgctggcgctcgcggcgtttagcgtcatcttcaatcgcttccgcgccgtagcccgctttttccaccgcctgcactaaatcttgtggggaggcactgcccatcaccagcgcagtacgctccgccaggtttacccgtgcctgagtgacgcccggtacgctttgcaacgcattttgtacgcgggtgacacagctggcgcagctcatgccgctcagcagcaactgctggctgtcatcgtcatcggcggtcgctgccggaagcgcctcagaaaccgctgtcagtgcttccgacgggattgatgactccgccagcggtttagcctttgggtggcttacagatgcgtcataacccgcttgtttgatggtttcgatcagctgttctgcactggcagtcccggtaacgtgcgcttcagtgatagacacatccgcctgttcaacatccgggcgctgttcgagactttctttcacgcgtttaacgcagtgaccgcaggacaggccgtccagggtcaggtcgatagtttgtgacataaaacactcctttaagacagttttgactggctgtgataaaggttaaaccttccagcaaggggaaggtcaagaaattaataaaccaggcgggtaaaagtccgtaaagattaaaaaatcggctcgatttgcatcaggattagacatttatctctttgttttcctgtagttaagttgcgggtgctaagttaaatcaggatgcatgaaaatcggcaccggggtgaggaattacctcccgcatctataaaaaggagttaacaaaagatgttagatgcaaacaaattacagcaggcagtggatcaggcttacacccaatttcactcacttaacggcggacaaaatgccgattacattccctttctggcgaatgtccctggtcaactggcggcagtggctatcgtgaccagcgatggcaacgtctatagtgcgggtgacagtgattaccgctttgcgctggaatccatctcgaaagtctgtacgttagcccttgcgttagaagatgtcggcccgcaggcggtacaggacaaagttggcgctgacccgaccggattgccctttaactcagttatcgccttagagttgcatggcggcaaaccgctttcgccactggtaaatgctggcgctattgccaccaccagcctgattaacgctgaaaatactgaacaacgctggcagcgaattttacatatccaacaacaactggctggtgagcaggtagcgctctctgatgaagtcaaccagtcggaacaaacaaccaacttccataaccgggccattgcctggctgctgtactccgccggatatctctattgtgatgcaatggaagcctgtgacgtgtacacccgtcagtgctccacgctcatcaatactattgaactggcaacgcttggcgcgacgctggcggcgggtggtgtgaatccgctgacgcataaacgcgttcttcaggccaacaatgtgccgtacattctggccgaaatgatgatggaagggctgtatggtcgctccggtgactgggcgtatcgcgttggtttaccgggcaaaagcggtgtaggtggcggtattctggcggtcgttcctggcgtgatgggaattgccgcgttttcaccaccgctggacgaagaaggcaacagtgttcgcggtcaaaaaatggtggcatcggtcgctaagcaactcggctataacgtgtttaagggctgatcatgatgaacacggaaggtaataacggtaacaaacccctcggtctatggaacgtcgtttccatcggcattggggcaatggtgggggcggggatcttcgcgctgctggggcaggctgcgttgctaatggaagcctcgacctgggtcgcctttgcttttggcggtattgtggcgatgttttccggttatgcctatgcgcgtctgggggcgagctatcccagcaatggcggtattatcgacttctttcgtcgcggattaggcaacggcgttttttcgctggcgctctcgttattgtacctgttgacgctggcggtgagtatcgccatggtcgcccgtgcttttggcgcttatgccgtgcagtttttgcatgaaggcagccaggaggagcaccttattttgctctacgcattggggagcattgcggtgatgacgcttttcaactccttaagcaaccatgcggtagggcggctggaagtgatcctcgtcggcattaaaatgatgatcctgttattgctgattattgccggtgtctggtcgctgcaaccggcgcatatttccgtttctgcgccccccagctccggggcgttcttctcctgtatcgggataaccttccttgcctatgcgggctttggcatgatggcgaacgcggcggataaagtgaaagatccggaggtcataatgccacgggcgtttctggtggcgattggcgttaccacgttgctttatatctcgctggcgctggttttgcttagcgatgtatcggcattagagttagaaaaatatgccgataccgccgtagcgcaggctgcttctccgctcctcgggcatgtggggtatgtgatcgtcgtcatcggcgctttactggcgacggcttcagccatcaacgcaaacctgttcgccgtgtttaacatcatggacaacatgggcagcgaacgcgaactgccgaagctaatgaataaacctctgtggcggcagagtacctggggcaacatcatcgtcgtggtgttgattatgctgatgacggcggcgctgaatttaggctcactcgccagcgttgccagcgccacctttttgatctgctatctggcggtgtttgtggtggcgatccgcctgcgtcatgatattcacgcctcgttgccgattcttatcgttggtacgttggttatgttgttggtgatcgttggctttatctacagtctctggtcccagggcagccgtgcgctgatatggattattggcgcactcttactcagccttattgtggcaatggtcatgaagcgcaataaaaccgtataacatctctctgtgcgcagtacttcctgtattattgtggtggcggtcgatattcgcactggcaaaaaaacgtgcttgaatatttgttgaaaccctttaacaaagcacaggaggcgttgcgcgaacgatgaacattagcgatgtagcaaaaattaccggcctgaccagcaaagccattcgcttctatgaagagaaggggctggtgacgccgccgatgcgcagcgaaaacggttatcgcacctacacgcagcagcatctcaacgaactgaccttactgcgccaggcacgccaggtgggctttaacctggaagagagcggcgaactggtaaatctgtttaacgatccgcagcgtcacagcgccgacgtcaaacgtcgtacgctggagaaagtagcggagatcgaacagcatatcgaagaactgcaatccatgcgtaaccagctgctggcgctggcgaatgcctgccccggtgatgacagcgccgactgcccgattatcgaaaatctctccggctgctgtcatcatcgggcggggtgattaaggcttgcgaaaatagtcgtccattattttcgtcagctccggacgttccccgtcatcattgatggcaaaatccagaaaaaaagcatctgtttgcggcgttcggttttgcgccatcaaccggaaggtgagggggcgataaatggcgtatgccggatggctgataacgaatcgggcaaagtcaataaaaagcggcgagtgtgtggaaaacagcgcctgcaaaataatatcagccttttcatcctcccccaaaccttgttggatcatgctcttaatacgagtttcgctcaaattcccggcctcaacaatttgccaggcttgatccagcgaggggtaccgactgacgctctgctttaactcttctgaccaggtttcggatgggctgatgtgcttatcagggccgaaactctcccatgcgctgggcggtaatgttttgcacgcggtgagttttggtatgtggtattgcagctctgttttgtgcagacattccccgccaggaaataccagggtttgttgctcatcattaaaatgggttgccgtgctgagcaccagtgttttgagcggtcgcccttccagcgcggcggcagtagccttatggtgtccgtcgagcagaacgcagagataggaatcagggagataccaggccagagcgcgggcgtccggtttatcgcgataaaacgtcgcacgctcaggattaaaatgtgatggcggctggccgggtagaagaaagcagggcgcggtgtcactgaaagagcaatattcaggatcccagacggcaacggttgccggattactggaactatggtccgttgccgcccaaaagaaatgcccgttgccatccgtcgggtaaagttcacgatcttccagcaaataataaccatcagccatgcatgagaacagcggtgtcagcgcggcaaaagcgtccgttatgccagaccacgggcgattccagttttcgagagcagacaaaaaccgggcggctccttgttcatcctccgcaaaaccgctgtagacaaattccgcacaggtagggcatccagcctcggaccagaaacgtattaacgggacatcctgccagcagagcgaatggataagaccgtgcgagtgcggatcgtaaatcacacattgacgcagaaatcctttcccggacttcaccgaaaaaatgacgcccgcagcggtatttttcagcagacgtatttcaggttttcgaaagggggaaaacatggctactccttagccgaacattcaattaacactatgtagggggctatatgccggatgcggcgtaaagccttatccggcatgggttttggtacagatttccaggtgtgataagacgcgtcaggcgatgaccgcacggataatcagcgttattccttctatcgcaatcacctcaacatgcgtaccagcgccgagatcctcgctggcgctgacaggccatgaactgtcaccgacgcgcatatgaccgcgcccgttgaccagtggagattccagcacaaaacgtcggccaatcagctgctgcccgcgctggtttaaatgactgtcgctgtgcttttgttcgcgcacccgccgcgacagccatttccaccacaaccaggcggcgagcagtgtcagaatggcaaacatcaccccttgccactcccaacccagcggcaccagccagaccaccaggccggtaatcaccgctgccacgccgctccacaacagataaccatttccgcccaacatctcggctgccagcagcaacccgccgagactgagccagaaaatatgtggatgaacgaccattaactccatcatggctgagtccgtttgttggcgctgtctttcaccagctcggcaatcccggcaatcgaccccatcaggctgctggcctctaatggcatcatcactactttgctgttactggaggaaccgatctgctgtaacgcttcggtgtatttctgtgctacgaagtagttcaccgcctgaatatcgccggaggcaatggcttcagacaccattttggtggcgcgggcttccgcttcggcagaacgttcacgcgcttcggcctgtaagaatgccgactgacgttcaccttccgctttcaggatttgcgactgtttttcaccttcggctttgaggatttccgcctgacggatcccttccgcttcaaggatgtaagcgcgtttggtacgttccgctttcatctgcgcgttcattgaagagataagctctgccggtgggcgcacgtcgcgaatttcaatacgggtgactttaatcccccacgggttggtggcctcatcgacaatacgcagcaggcgtgagttgatgctgtcgcgctgagagagcatttcatcaagttccattgaacccaacacggtacggatgttagtcatggtcaggttgatgatcgccagctccagattgctgacttcataagcggcgcgcggggcatcaatcacctgaataaagcacacggcgtcgatggtaacgttggcgttatctttcgagataacttcctgggaagggatgtcgagcacttgctccatcatattgatcttgcgaccaatgcgatccataaacggcaccaccagactgagccccggctgtaacgttttggtatagcgaccaaaacgttctaccgtccattgatagccctgcggcacgattttgacgcccgcgccgacaatgaccagcgcgacaaaaatgagaatagggataaagataagcatcggaaaaacctcctgttgtaccgtccataatcagcaaaattgctgcttgattaaacaaattatacctgattactgaaagagagttcccccttattcctgcgaaggataaactgtttttagtaaaaatcagaaaaagggaacagtgatgcaggaaaatagtcctttgcttcagctacaaaacgtaggatatctggcgggtgatgcgaagattcttaataacatcaatttttcgctgcgtgctggcgaatttaagttaattaccggtccttctggttgtggcaaaagtacgctgctaaaaatagttgcttcattgatcagcccaaccagcggaacgttactgtttgaaggtgaggatgtcagcacactaaagccagaaatctaccgccagcaagtctcttactgcgcccagacgccgacgctgtttggcgatacggtatacgataatctgatctttccctggcagatccgtaaccagcagcctgacccagccatttttctcgattttctcgaacgcttcgctttgccggacaccattttgacgaaaaatatcgccgagctatctgggggtgaaaaacaacgcatctcattgattcgtaacctgcaatttatgccgaaggttttattgctggatgaaatcaccagtgcgctggatgaaagtaataaacataacgttaatgagatgatccatcgttatgtgcacgagcaaaatattgccgtgctgtgggtgacacacgataaagacgaaattaatcatgcggataaagtgattacactgcaaccgcatgccggagaaatgcaggaagcacgctatgaactcgcataatattactaacgaatcattggcactggcattaatgctggtggtggtggcaatcttaattagccataaagaaaaactggcgctggagaaagatattctctggagcgtcgggcgcgcgataattcagctgattattgtcggctatgtgctgaagtatattttcagcgtggatgatgccagcctgacattattgatggtgttatttatctgctttaatgcggcgtggaacgcgcaaaaacgcagtaaatatattgctaaagcttttatctcatcgtttattgccattacggtcggggcgggaattactctggcggtgctgattttatcgggatcgattgagtttatcccgatgcaggtgatccctatcgccgggatgatagccggtaacgccatggtagcggtggggttgtgttacaacaatttagggcaacgggttattagcgaacagcaacagattcaggagaaactgagtcttggcgcgacgccgaaacaggcttcagcgatattgattcgcgacagtattcgcgcggctttaattccgacggtcgattcagcaaaaacggtaggcttagtgagtttaccaggaatgatgtccgggctgatatttgccgggattgatccggtgaaggcgattaaatatcagattatggtgacctttatgctgctctcaaccgccagcctgtcgaccattattgcctgctatttaacctatcgtaagttttacaattcgcgccaccaattggtggtgacgcaattgaagaagaaatgatgcgatgccggatgcgcagcatcgcatccggcgttgtggttcatgtgccgatcaacaaaacatcaatacaacaacgcatacagctggcggcgatacttcgacgccagtgcatcacccgtacccagcgcagcgaggatctcctggaatgttttacgtgtctgaccatctgcggcggtgagatctttacgcagatgcccaaacagtaactccagcgcctcttcattgcgcccaacctggtgcagttgcagtgccagttgcgtcgccagtgcggcatcttcaggattctccgccacctgctgttgcaactgttgaatttccggcgtatcagccgcctgcttcagcagttcgatttgcgccaccagcccctgatagcgggtgtcctgatcctgcaacggaatggttttcagcacggcttctgcatcttcagaacggttcagcgcaatcagcgtttctgccaacagcaggccgatctccccgttctgattcgacaactgccaggcgtctttcagcaatggcagggcgtcggtgtgattgccttcctgcatcagttgcatcgcctgctgcgctttcagctcttcttcacgcggcagcactttatccagcagggcgcggatcgcctcttccggttgcggcccctggaaaccgtctactggttgcccgttctggaacagatatacggtcggaatcgcgcgcagaccaaactgggcggcaatcatctgctccgcgtcgcagtccagcttcgccagaataaattgcccgttgtactgcgccgcgaggctttccagaatttgggttaactgcaaacagtgctggctacgttcagaccaaaaatagaacagcaccggagtggtcatcgactgttcaagaacctgttgcaggttagattcgttaatgttgacaatattttctacggacatggagtcgctctctgttgtcgatattttctttgacatgggggcttaagcgcgcgcttcaactcacccctgcaatattttgtccatcacgcgccccggcagcaggcgcttaagcaccattaccgcccaggtcaccagcgtcaccggatagcgcatcttcggcttctcgctaataaaagcatggcgcactttgtcgaccaccgcttccggtcccaacgtaaagcgggcggcgatgccaggattttcgactggtttatcactttgcgtctgattgacgttgtcggtgaagcgagtacgaatgggaccaggttcgatcaggctgactttaattccgctgtggcgcagctccatgcgcagtgcgtctgaccacgcctccagcgcatatttactggccgcgtaagcgccacgacccggtgtggagattaatcccatcaccgatgaggtcatcacaatacgcccttcaccgtgcggcaacatcgcgggtaacaggcgcatggtgagctggtgtgcgccgaaaaagttggcggaaaactgctgttccatctgcgcacggctgatggtggaaagggggccatacatgccgaatccggcattgttaaagatcccatacagacaattatcggtcagggcgatcacttcgtcggctgcgcgatcaacactttctggcgaatccagatcgatcaacacgccggtaaatcccatgctgttcatgcgctcaacatcatccggtttccggcaacctgccagcacatgaaaaccctggcgttttaattcgagtgcgctttccaggccaataccactggaacatccggtaattaagaccgatttttgcataactttacctgtcaggatctccgttgctttatgagtcatgatttactaaaggctgcaactgcttcgccatccagtcggcaataaacggctgggcgtcgcggttgggatgaataccgtcatcctgcatccattgtggcttgaggtagacctcttccataaaaaagggcagcagcggaacatcaaactctttggcgagtttgggataaatggcgctaaaggtttcattataacggcgaccatagtttgcaggcagacgtatttgcattaacaatggttcagcgttggcggctttgacatcctgcaaaatctggcgcagcgtctgctcggtttgctgtggctgaaaaccacgcaaaccgtcattgccgcccagttcaaccagcacccagcgcggctgatgctgtttcagcagagccggaaggcgcgccagcccttgttgcgaggtgtcgccgctgatgctggcattgactaccgacgttttactctgccacttatcattcaacaaggcaggccaggccgcgctggcagacattcgatacccggcgctcaggctatcacccagaatcaataacgtgtccgctgcagcggcacggaaggttaacaggaccaggaacaggaagggcaaatgccagcggaaaacattgttgaagttcatcatcttaagaagtccgtcggtcagggggagcatgaactctccatcctcaccggagttgagctggttgtcaaacgtggcgagaccatcgcactggtgggtgagtcgggatcgggtaagtcaaccttgctggcgatcctcgccgggctggatgacggcagcagtggcgaagtgagtctggtgggacaaccgctacataatatggacgaagaagcgcgggcaaagttgcgcgcgaagcacgtaggctttgtttttcagtcatttatgttaattcctacccttaacgcgctggaaaacgtcgagcttccggcgctgctgcgcggtgagagtagcgcagaaagtcgtaacggggcgaaagcgttgctcgaacagttagggttgggtaaacgtcttgatcatcttccggcacagctttctggcggcgaacagcaacgagtggcgctggcgcgagcctttaatggtcgacctgatgtgctgtttgccgacgaacccaccggcaaccttgaccgccagacgggcgataaaattgccgatctgcttttttccctcaaccgtgagcatggcaccacgttgattatggtgacccatgacctgcaactggcggcacgctgtgaccgctgtttacggctggtgaacgggcagttgcaggaggaagcatgattgcacgttggttctggcgcgaatggcgctcgccgtcgctattaattgtctggctggcgttaagcctggcggtggcctgtgtgctggcgctgggcaatattagcgatcgcatggagaaaggtttaagccagcaaagccgtgagtttatggcgggcgatagggcgttgcgcagttcgcgcgaagtgccgcaagcgtggctggaggaagcgcaaaagcgcggcctgaaagttggcaagcagctgactttcgccaccatgacctttgcaggcgacacaccgcagctggcgaacgtcaaagcggtggatgatatctacccgatgtatggcgatctgcaaactaatccccctggcctgaaaccgcaggcgggcagcgtattgctggccccacgcctgatggcactgcttaacctgaaaacgggcgacaccattgacgtgggcgatgccaccttgcggattgccggagaagtgattcaggaaccggattccggttttaatcctttccagatagccccacgcctgatgatgaatctggcggatgttgataaaaccggagccgtgcagccggggagtcgggtcacctggcgttataaattcggcggcagcgagaaccagctcgacggctatgagaaatggttgttaccccagcttaaacctgaacaacgctggtacggtctggaacaggacgaaggcgcgctggggcgatcgatagaacgttcgcaacagttcctgctgctttcggcgcttctgaccttgctgctggcggtggcggcggttgcggtggcgatgaatcattactgtcgcagtcgctacgacttggtggcgatcctcaagacgctgggggcagggcgagcgcaactgcgtaagttaatcgtcggtcagtggttgatggtgctggcgctttcagccgttaccggtggggcgataggcctgttgttcgaaaacgtgttgatggtgctgctcaagcccgttctgcctgctgcactaccgccagccagcctctggccgtggctgtgggcgctcggcaccatgacggttatttcgctgctggtggggctacgaccgtaccgactgttactggccacgcagcctttacgcgtattacgtaatgatgtggtagcgaacgtctggccgctgaagttttatctgccgattgtcaccgtggtggttgtgctgctgctcgccggactgatgggtggcagtatgctgctctgggcggtgctggcgggcgcggtagtactggctttgctgtgcggtgtgctgggctggatgctgctgaatgtacttcgccgcatgacgctgaaatcgctacctctgcgcctggcggttagccgcctgttacgtcagccgtggtcaacgttaagccagctttcggcattttcgctctcctttatgctgctggcactgttgctggtgttgcgtggcgatctgctcgaccgttggcaacaacaactgccgccagaaagcccgaactactttttaatcaacatcgctacggaacaggttacgccgctgaaagcgtttctcgcggaacatcagatagtcccggaatcgttttatccggtggtgcgggcgcggttgacggcgattaacgacaagccgacagaaggcaatggagatgaggcgctcaaccgcgagctgaatctcacctggcaaaatacgcggcctgatcataacccgatcgtcgccggtaactggccgccaaaagccgatgaagtgtcgatggaagaggggctggcgaaacgcttaaacgttgccctcggcgataccgtgacttttatgggcgatacccaggagttccgcgctaaagtgaccagcctgcgcaaagtggactgggaaagtctgcggcctaatttctattttattttcccggaaggggcattagacgggcaaccgcagagctggcttaccagtttccgctgggagaatggcaacggcatgttgacgcaactcaaccgccagttcccgaccattagcctgttagacattggcgcgattttaaaacaggtcggtcaggtgctggagcaggtaagtcgggcgctggaagtgatggtggtgctggtcaccgcctgcggtatgttgttgttgctggcacaggtgcaggtgggaatgcgtcagcgtcatcaggagctggtggtgtggcgcacacttggtgcggggaaaaaactgctgcgcacgacattgtggtgtgagttcgccatgctcgggtttgtatccggcctggtggccgcaattggtgcggaaacggcactggcggtactgcaatcgaaagtgtttgatttcccgtgggagccagactggcgattgtggattgttctgccgtgcagcggtgcgctactgctgtcgctttgcggcggctggctgggtgcgcgactgcttaagggtaaggcgctgttcaggcagtttgcggggtgatgacaggtgttagattgcctgatgcgctacgcttatcaggcctacgaagatcgtgcaatatattgagttttcgaaattttgtacgccggataaggcgttcacgccgcatccggcagttgtgcgccgatgccagatgcgacgcaggcgcgtcttatcatgcctacgaaacagcactcacctgtaggctggataaggcgttcacgccgcatccggcatgaacagcgtgcacagaatcccccatcactgcgccttaacccattccgccacttccgcccactcaccgcgaaagacaactttttccgcttttttctcaagctgatagcgatacatcgggtcgtaatattcttcaagtaacggcaccagccaggccagatgaccgtcggtgctgccggtggtgagttgcgttgtcagcgccgcatccagccttgcagccagttcgttatagcgttgtagtcccagccgacgtttaatcgccgaaagcccgtgatgcaggtattcgcaatactcctgccagccctgttcgtcgccataagcgtgggtaaaatcatgatgcatacgcaagaaatactcttcgttcaggcgttcaagacggatctcaaacggatcttctaccaccgcaatcgtcgcctgagtcattcgttcgcgcagacattccggcaggtgattcgaaccgatcatccggctttcatcttccagcacccacaggcgcaaatcctgatgggcgtcggtttttagcatttcggcagccagcatgttttcaaaactcgcctggctaagttgtggttgtaaggtgcgaccaaacgccgaaccgcgatgacgcgccaacccttccagatcaacaccgttcggctgttgctgcactaacagcgttttaccgctgccggtacaaccgccaatcagcacgatcggtttttgtgccagttcaatagtcgcctgaatcgcggtctggcgcagtgccttataaccgccttccaccagcggataatcaatccccgcgtcatgcagccagcgttgcacaatatgcgagcgctgaccgccacgggcgcagcagagaataccgtgcggattttgcaggcacgctgcccgccaggcgtctatacgctgctgacgaatttcacccgccaccagtttatgccccagcgccagcgccgcgtctgacccttgctgtttatagcagatgccaacggcggcgcgttcatcgttattcattaacggcaggttgatagcggcgggcattgcgccttgctcaaactcgatgggggcgcgaacatcaataatgggcgtatcagcaatcagcagggcacgatagtcctgttccgtgtgtctctcttgcatagtaaaaagtgaacctcaaatcagcttgcgcgctattttacgcgccaacgtgcaaggaaacttgatttttaactgcgtgggttgccgaaaatttctaaaaatccgctgatttccggcctgcgctgggtaaacaaggtcacaatatcttctaccgctttgccgctgccaaatttgcgccatgccagactcaatggcgaaggagggcgcatcgttgggattacccggctgaccagttgttgattatcgagcattgactggcaaagtgattttggcaaaaaaccaatgccaacgcccgccagatgggcggcgattttcgtttccatatcgggaacaataatctctttttgccccggcaatcgccaggcgacgcgtttggttaaggtgcgggcgctgtcttcaatattgaccgccggaaagcgccgcaactgtgcttctgttagcggctcttcaacgttcgccagcggatgatccgccgccatgacaaagcgccattgcaccgatcctaagggatcaagactaaaggtatttgccagcgcctcggttcccgtgacgccgatagccagtgaaaaaccttcgtacaatagcgagtcccagacgcccatatagatttgtcgggagatgtgaaattgggtaaacgggtaacgttcatttagccacgccagcagcctggcaacggcctgggggttatagagcaggttgttgatgacgatattcacctggcgttccacgccatcattcacctgttgtaactcgctgggcatactttccagccagctcagccagtctctggcctgacaaagtagatgctcgccagccgccgtcaacgtcacgctgcgagtcgtgcggaaaaacagcgccactccggtattctcttccagaagtttaatgcgataactgatcgtcgccgtggttttacataatcgttctgccgcttttgaaaaacttcctgtttcagcaaccgcaatgaaagtccgcaaggtttctggatcgaacatcttcaggtatccccttttaaatccgcaagttgcgtgattttcttatcctctgatttatcagtatttttacatgataaccctgttcaatttgtggactaaatctagttttggaaaaatattccaacttttgtattgatgttgttctcttaaggttttagattgcctgttattgaaaccaagctgaccggtcggcggtggttgaacggaattatgttacaaggacaaaaagatgaaacttcaggtattaccgttaagtcaggaagcctttagtgcttatggcgacgtaatcgaaacgcagaaacgggattttttccatattaacaatggactggtggagcgttaccacgatttggcgctggttgagattcttgagcaagaccgtacgcttatcagcattaaccgcgcgcaaccggcgaatctgccgctgactattcacgaactcgaacgtcatccgctgggtacacaggcgtttatcccgatgaaaggtgaagtgtttgtggtggtggtggcgttaggtgacgacaaaccagacctgtcaaccctgcgggcgtttattaccaatggcgaacagggagtgaattaccatcgtaacgtctggcatcacccacttttcgcctggcagcgcgtcaccgattttctgaccatcgatcgcggcggcagtgacaactgtgatgttgaaagtattcctgaacaggaactctgttttgcgtgacgcctgcaaccgacttgcataagataaacgaattgttcattgtttatgctcatttgtaggtcggagttaacgtaggtatgacggaagttagacggcgcggcaggccaggacaggcggagcctgtggcacagaagggtgcacaggcgttagagcggggaattgcgattctgcaatatctggaaaaaagtgggggaagttcgtcggttagcgatatctctctcaatctggatttgccgctctccacgacctttcgcttgctgaaggttttacaggcagcggattttgtctatcaggacagtcagttaggctggtggcatataggattaggtgtctttaacgtcggtgcagcgtacatccataaccgcgatgtactctccgtcgccgggccgtttatgcgccgcctgatgttactttccggcgaaacggtcaatgtcgcgatccgtaacggcaatgaagcggtattaattggtcagttagagtgtaaatcgatggtcaggatgtgtgcgccgctgggcagtcgtctgccgctgcatgcttccggagcgggcaaggcgctgctttatccgctggcggaagaagagttgatgagcatcattctgcaaaccggtttgcagcagtttacgccaacgacgcttgtggatatgcccaccttgctgaaggacctggaacaagcgcgtgaactgggctataccgtagataaagaagagcatgttgtcggcctgaattgtatagcttcagcaatttacgatgatgtaggtagtgttgttgccgctatctccatctccgggccttcatcaagactgacagaagatcgttttgtcagccagggtgagctggtcagagacaccgcccgcgatatcagcacggcgttgggactgaaagcacatccatagtgtctgtcgtatcccgctctgcggagcgggtttttttgacaaaatttgagagttggaaaatttttccaattaatagaggtaggaataaaatggcaaaaatgagagccgttgacgcggcaatgtatgtgctggagaaagaaggtatcaccaccgccttcggtgttccgggagctgcaatcaatccgttctactcagcgatgcgtaagcacggcggtattcgtcacattctggcgcgtcatgtggaaggtgcttcgcacatggcggaaggttatacccgcgcaacggcagggaatatcggcgtatgtctggggacttccggtcctgcgggcacggacatgatcaccgcgctctattccgcttctgctgattccattcctattctgtgtattaccggccaggctccgcgcgcccgtctgcataaagaagatttccaggccgttgatattgaagcaattgctaaaccggtcagcaaaatggcggttacagttcgtgaagcggcgctggtgcctcgtgtgctgcaacaggcgtttcacctgatgcgttctggtcgaccgggtccggtactggtggatttaccgttcgacgtacaggttgcggaaatcgagtttgatcctgatatgtacgaaccgctgccggtctacaaacctgctgccagccgtatgcagatcgaaaaagctgtagaaatgttaatccaggccgaacgtccggtgattgttgccggaggcggggtaattaatgctgacgcagctgtactgttacaacagtttgctgaactgaccagcattccggtgatcccaacgctgatgggctggggctgtatcccggacgatcatgaactgatggccgggatggtgggcctgcaaaccgcgcatcgttacggtaatgcaacgttgctggcgtccgacatggtgtttggtatcggtaaccgttttgctaatcgtcataccggttcggtagagaaatacaccgaagggcgcaaaatcgttcatatcgatattgagccgacgcaaattggccgcgtactgtgtccggatcttggcattgtctctgatgctaaagcggcgctgacgctgctggttgaagtggcgcaggagatgcaaaaagccggtcgtctgccgtgtcgtaaagagtgggtcgccgactgccagcagcgcaaacgcactttgctgcgcaaaacccacttcgacaacgtgccggtgaaaccgcagcgcgtgtatgaagagatgaacaaagcctttggccgcgatgtttgttatgtcaccaccattggcctgtcacaaatcgctgcggcacaaatgctgcatgtctttaaagaccgccactggatcaactgtgggcaggcaggcccgctgggctggacgattccggcggcgctgggggtttgtgccgctgatccagagcgcaatgtggtggcgatttccggtgacttcgacttccagttcctgattgaagaattagccgttggcgcacagttcaacattccgtacatccatgtactggtcaataacgcctatctgggtctgattcgccagttgcaacgtgcctttgatatggattactgcgtacagctcgcgttcgaaaatattaactccagcgaagtgaacggttatggcgtcgaccacgtaaaagtagcggaaggtttaggttgtaaagcaattcgcgttttcaaaccggaagacattgccaaaattggtcacctgcaaattgctgataatccgcatcgcggcgaaccgggaaccggagaaattaattacgaatatctctttacggtaattgaaaattctgactacaacggttgggttggctgtgaatataaaccccaaaccaccacggaagccggtttacgctggatggatccgtaccgttaaaacgtaacgctattcagacaatgcttttttaggccgctaagttggcaggggatcgtgttgtctgaattcaggaaaagcgaaatttaaaagaggttaattatgaaactgggatttattggcttaggcattatgggtacaccgatggccattaatctggcgcgtgccggtcatcaactgcatgtcacaaccattggtccggttgctgatgaattactgtcactgggcgccgttagtgttgaaactgcgcgccaggtaacagatgcatcggacatcatttttattatggtgccggatacgccacaggttgaagacgttctgtttggtgaaaatggttgtaccaaagcctcgctgaagggcaaaaccattgttgatatgagctccatttccccgattgaaactaaacgtttcgctcgtcaggtgaatgaactgggcggcgattatctcgatgcgccagtctccggcggtgaaatcggcgcgcgtgaagggacgttatcgattatggttggcggtgatgaagcagtatttgaacgtgtaaaaccgctgtttgaactgctcggtaaaaatatcactctcgtgggcggtaacggcgacggtcaaacctgcaaagtggcaaatcagattatcgtggcgctcaatattgaagcggtttctgaagccttgttgtttgcttcaaaagccggtgcggacccggtacgtgtgcgccaggcgctgatgggcggctttgcttcctcacgtattctggaagttcacggtgagcgcatgattaaacgcacctttaatccaggtttcaaaattgcgctgcaccagaaagatctcaacctggcactgcaaagtgcgaaagcactggcgctgaacctgccaaacaccgcgacctgccaggaattgtttaatacctgtgcggcaaacggtggcagccagttggatcactctgcattagtgcaggcgctggaattaatggctaaccataaactggcctgatacccgcaataaaaatggccgatatcagaaaatgaatcggccagcaatattaaaaaaagaaagcagccaaagatgttgcttcagtattaaaaataatatttttattttatttgttcctcatagctagattaaaacaacattattcgatacgtgaaattaagagggatttatggaacatcagagaaaactattccagcaacgcggctatagcgaagatctactgccgaaaacgcaaagtcagcggacctggaaaacatttaactattttaccttatggatgggttcggttcataacgttcccaattatgtgatggttggcggcttttttattctcggcttgtctacctttagtattatgctggcaattatcctcagtgcctttttcattgccgcggtaatggtattaaacggtgctgcgggcagtaaatacagcgtaccgtttgccatgatcctgcgtgcttcttacggcgtacgtggtgcactgtttcccggattattaagaggcggtattgctgccattatgtggtttggcctgcaatgttacgcggggtcactggcctgcttgattctgattggcaaaatctggccgggatttttgactctcggtggcgatttcacgctgttaggcctttctctaccgggattaattacttttttactcttctggctggttaacgttggtattggttttggcggcggaaaagttttaaataaattcactgccattcttaacccgtgcatctatatcgttttcggcggtatggcgatttgggcgatttcgctggtcgggatcggtccaatctttgactacattccgggcggtattcagaaagcagaaaacagtggcttcctgtttctggtggtgataaacgcggtggttgcggtctgggcggcaccggcggtgagcgcatccgactttacgcaaaacgcccactcgtttcgtgagcaggcgctggggcaaacgctgggtttagttgtggcctatattctgtttgcggtcgccggggtatgtattattgccggagccagtattcattacggcgctgacacctggaacgtgctggatattgttcagcgttgggacagcctgttcgcctcgttctttgtggtactgattattctgatgacgactatctctactaacgccaccggtaatattattccggctggttatcagattgccgccattgcaccgacgaaactgacctataaaaacggcgtactgattgccagtattatcagcctgctgatctgcccgtggaaattaatggaaaatcaggacagtatttatctgttcctcgatattatcggcggaatgcttggtccggtaattggtgtgatgatggcgcattattttgtggtgatgcgtgggcaaattaatcttgatgaactgtacaccgcacctggcgattataaatattacgataacggttttaacctcaccgcgttttcagtaactctggtggccgttattttatctcttggcggtaagtttattccctttatggaaccgttatcacgtgtttcatagtttgtcggcgtcatcgtcgcctttgcggcctacgccttattaaagaaacgtacaacagcagaaaaaacaggagaacaaaaaaccataggttaattaatcacgatattgaacattgagttaaaaaccaatctgtattttacaaggagtttgttatgtcttttgatttaatcattaaaaacggcaccgttattttagaaaacgaagctcgcgttgtagatatcgccgttaaagacggaaaaattgctgctatcggccaggatctgggcgatgcaaaagacgttatggatgcgtctggtctggtggtttcgccgggcatggttgatgcgcacacccatatttctgaaccgggtcgcagccactgggaaggttatgaaaccggtactcgcgcagcagcaaaaggtggtatcaccaccatgatcgaaatgccgctcaaccagctgcctgcaacggttgaccgcgcctcaattgaactgaagttcgatgccgctaaaggaaagctgactatcgatgcggcacaactcggtggcctggtgtcttacaacattgaccgtctgcatgagttggatgaagtgggtgttgtcggtttcaaatgcttcgttgcgacctgtggcgatcgcggtatcgacaacgacttccgtgacgtcaatgactggcaattcttcaaaggcgcgcagaagctgggtgaactaggccagccggtgctggtgcactgcgaaaacgcgctgatctgtgacgcactgggcgaagaagcgaagcgtgaaggtcgcgtaactgcccatgactatgtggcttcgcgtccggtatttaccgaagtggaagcgattcgccgcgtactgtacctggcgaaagtcgctggttgccgtctgcacgtttgccacgtcagcagcccggaaggtgttgaggaagtgactcgtgcacgtcaggaaggtcaggatgttacttgtgaatcctgcccgcattactttgtgctggataccgatcagttcgaagaaatcggtactctggcgaagtgttcaccgccgatccgcgatctggaaaaccagaaaggcatgtgggaaaaactgtttaacggtgaaatagactgcctggtttccgaccactctccatgcccgccggaaatgaaagccggtaacatcatgaaagcgtggggcggtatcgctggtctgcaaagctgcatggacgtgatgttcgatgaagcggtacagaaacgcggaatgtctctgccaatgttcggcaaattaatggcgactaacgcagcagatattttcggtctgcagcaaaaaggccgtatcgccccaggaaaagatgccgacttcgtcttcattcagccgaatagcagctatgttcttaccaatgacgatctggaatatcgccacaaagtcagcccgtatgttggccgtactattggcgcgcgtatcacgaaaaccatcttacgtggtgatgtgatttacgatatcgaacagggcttccctgttgcgccgaaaggtcaatttatccttaaacatcagcagtaatctggccctgcaatgcccgtccttgtggcgggcattctccggttaaggtgtgtttatgttcaattttgcagtgggccgcgaaagcctgttatcaggatttcagtggtttttctttattttttgcaacacggttgtggttcctcctacgctactttctgcttttcagttgccgcaaagtagcctgcttacgctcacgcaatatgcttttcttgctaccgcactggcctgcttcgctcaggcgttctgcggtcatcgtcgcgctattatggaggggccgggcggcctgtggtggggaaccatcctgactatcacccttggcgaagcatcgcgcgggacaccgatcaacgatatcgctaccagtctggcggtggggattgcgctctccggcgtgctgacgatgttgattggttttagcggattaggccatcgcctggcacggttatttacgccgtcggtgatggtcttgtttatgttgatgctgggtgcgcaactgaccactatctttttcaaaggtatgctcgggctgccgtttggcatagccgacccgaattttaaaattcaattaccgccgttcgcgctctcggtggcggtgatgtgcctggtactggcgatgattattttcctgccacaacgttttgcccgttacggcctgctggtcggtacgataaccggctggttgttgtggtacttttgctttccttcttcgcattcgctctccggtgagttgcactggcagtggttcccgctcggcagtggcggtgctttgtcgccggggattattctgacggcggtgattacaggtctggtaaatatcagcaatacctacggtgcgattcggggcacggatgttttttatccgcagcagggcgcggggaatacgcgttatcgtcgcagctttgtggcgaccggatttatgacactgataaccgtgccgctggcggtaattccattttcaccgtttgtttcatccattggtttattaacccagactggcgattacacgcggcgttcgtttatttatggcagcgttatttgcctgctggtggcgctggttccggcactcacgcgactgttttgcagtatccctttacccgtgagtagtgcggtcatgctggtttcttatctgcctttactcttttccgcgctggtgtttagccagcaaataacgtttaccgctcgcaatatttatcgactcgcattgccgttatttgtcggcatatttttaatggcattaccgcctgtgtatctgcaagaccttccattaacgcttcgtcctctgctcagtaacggcttactggtcggaattttactggctgttcttatggataaccttattccgtgggaacgcatcgaataatttgttgaaaaaggattgataatgaagattgtcattgcgccagactcttttaaagagagcttaagtgcagaaaaatgttgtcaggcaattaaagccgggttttcgaccctctttcccgatgcgcactatatctgtttgccgatagcggatggcggcgaagggacggtggaggcgatggtcgccgcgacggacggtaacatcgtgaagcttgaagtctgcgggccgatgggcgaaaaagtgaaagctttttatggcattaccggcgacgggaaaacggcagtgattgagatggcggcagcaagtggcctgatgttggtcgcgcctgaaaagcgtaatccgttgctggcctccagttttggtacgggggagttaattcgccatgcgctggataacggcattcgccatattattctcggcattggcggcagtgcgacggtcgacggcggtatgggcatggcgcaggcgctcggtgtgcgtttccttgatgccgacggtcaggcgctggcggctaacggcggcaatttagcgcgcgtggcaagcattgagatgaatgaatgcgatccgcgtctggcgaactgtcatattgaagtagcatgtgacgttgataacccgctggtaggggcacgcggcgcggcggcggtgtttggcccgcaaaaaggggcaacgccggagatggtcgaagagctggaacaggggctgcaaaattacgcccgtgttttacaacagctaactgaaatcaacgtctgccagatggctggtggcggcgcggcgggcggtatgggcattgcggcggcggtattcctcaatgcggatattaaaccgggtattgagattgtgttgaatgcggtcaatcttgcgcaggcagtgcagggtgcagcactggtgatcaccggggaagggcgcatcgactcgcaaacggcaggcggtaaagcgccgctgggtgtggcatcggtggcgaagcagtttaatgtcccggtgattgggattgctggcgtattgggtgatggcgtggaagtggtgcaccagtacggcattgatgcggtattcagcattttgccacgtctggcacctttagccgaagtgctcgccagcggtgaaaccaatctcttcaacagtgcgcgaaatattgcctgcgccattaaaataggtcagggaattaaaaactgactattacctttaaagcggatgcgatttatatcgcatctttttttacctgaattgactacaaaaaaagccacggtataaaccgtggcaaaatccaacatagctaaaaataatcaggcgagtggtatgacttaaatctctacgtcgcggttgcaatctttcgagtaaatatagctgaacgcttcaccacgccctacgccataaccagcctgtaaagaataagcgcccataaagatgtaatcgccttttttcaccgggatccagttattgtcgaggttataaaccccctgaccggaaagaatataggcaccgtgttcctgaacgtgggtttcgatataaccgtggctggcacctggtgcaaaagagaggatatgcatgttcatatcaaaacctaactctttgggcagaaaatccagcagaataacatcgtccatgccttcataatgaatgcgttccagttcgctggcattgccagaaaccagccacggcgcatgaccttctaccggaatatagcgacgcttatataaaaagatttggctgtcttcggcctgggcgttaacaaacgtcattaaggagcctggcgggcaataaagatagccaccttcacttaaggtaaatgttttcccttcggctttggcagtgatatttccagagatcacatacaggaacgtttcaatgccttcgccaccgaagccctgttggttgccgccgttttgatgcagtgtgaccagataatcaacaaaagaggcacccagctttggcgtggagaggattgtcgcgtcacaattttcaaagcccggaataatattttttaccagaccgtctggtgttaacagtgcgaaattaccgtgtttaacaatcgcacggttagccagtaaatcttcgcggtaaccggtgacgttatttaaatatcccatttataactccttatttctgccaggcaagttgataaagcatgagtgccaacgttttgaccccttcggcaaggtcggtaatattggtgcgttccgccgggttatggctgatcccgttgatgctgggaatgaaaatcatgcaggtcggcacgcgaggcgcgaaaatttgcgcgtcgtgcccggcaccactgtgcattacccggtaattcagtttttcgctttcacacaattctgtcagggtggcgaccagctccttattcatcggcacgggttcttcgtccatccataaatcgatatcaataccaatatccatttcatcgcaaatcgcccgcatgtcgttttctaactgttgggtgaaatcgcgcagcacggtagcatcggtatgacgacaatcaatggtgaacgtggttttacccggcactacattcaccgtattcgggcgcggctctactttgccaaaggtcagaaccagcgggtcgcccatctttttcgctttttcgacagactgatggcaaatgcgactgaaagcgtaaaccgtatcacgacgataacccatcggcgtggtgcctgcatggtttgattcaccgttcagcgtcaccgtataacgacgctgcccgacaattgcattcaccacgccaattgattgcccattactttccagcacacagccctgttcgatatgcagttcgacaaaggctttaatatcctgacgcggagttagtggggcgttcggcagagtaaatccgcaagccttcatcgcatcgacaaaactatttcctttggcatcacagatattccgcacgtcgtcaggattcgccagcccaaaaatatttttactgccccagaaaacatacgggaagcggctgccttcttcttctgccatcgccaccacttcgaccgtacgtaacggcgcgccgtattgcgttttcagccagtcaatagccagccacgccgccagcgcaccgaattgcccgtcgaggttaccgccgttaaccacggtatcgatatgcgaaccgctcagaatcacttcctgtggatattcggtgccactcaggcgaccgtataaattccccacttcatcgaaacgtgtttccagcccgcttgctgccattctttttttaaactgctgctgggtttccagccattccggcgaataaagtaaacgggtcatcccacccgctgggtcagcgccaaaagaggaaagccagggcagcgtttcttctatagcttgacggaaatgtgtaatcataagaaagtcctgtctcaataattattgcgcaaagggatttttcgtttcgtatgacgtgttataaagcgcgtcggaaattaaatactggtaaatatcatcaacaatttcgatgccttcgacggcggcttttcgttgtttaatatcctgatcctgtccgggataataaacctgattaaaaccgggcgcgggggtaatggtatttaattcgcgcatggtctggctaagatgttgacggaataattcgctggaggagaaaaagttcgggttaataactatatgtaattgccccaaattacgcccggcgtgtaaatcgtcatacatcgaactaacctgtcgcccgaacggtaagccgagtaagacgcctgagaggacgtcaatcatcatcatcaggccataccctttcggcccagcggcggggagcagagcatgtaccgcgaacggatcggttgttggtgcaccgtttttatcgactgcccaggtatccgggatagacatattgcgcgagcgggcgtcgagcacttttccccatgcctgtacggtagtcgccatatcgaaggtaaggatctcatcgccttctcccggcgcggcaaaggctagtgggttagtgccgtagtaaatttccgcgccgccaaacggcaccaccattggatcggactggcacagcgaaatgccaatcaatccggcgcgggcagcctgctgcacaaaataagagattgcgccgctgtgacccatccggctgataccgaccaccgcaacgcctttttgctgggcggttttgatggcatgttccatacccattttcgccgcgacctgtccggcggcattgtcggcatgtaaaattgccgagcacggtccggtttcctcaagacgaaactccggttcgcggttggtgccgccttttgaaatgcgttcggcgtagtattcaacgcgcaccgcgccatgagagtggatccctctggcatcggcgtaaaccaatacttcagccacggttgcagcgtgctcacgttttaacccagcctggcagagtttattctcgattagctggtggagtgtttcccgactgattttcatctgtcttcctttttaacgacggtgtgaagcatgactgcaattaacatacagggaaaatatctggattatgtgatccagacaggcaaaaaaatatagttagaatttatttgataatcttcgtgcttttaacctggtttttaaaacaaccatgcttattaaaaaataacgcgtaatagtctggcggttatttgaattcttttgttaataatccacgtgtgatattcatcaccttatttactcgttgtcatcgataccgtaatcgccacattaacactgctcgtgcaattgccatgggtgcaatttttaaggagttgttatgatccacgcctttattaaaaaagggtgttttcaggattcggtcagtttaatgattatttcacgaaaactcagcgaatcagaaaatgttgatgatgtttccgtaatgatgggtacgcccgccaataaagcgttattagatactacaggtttctggcatgacgattttaataatgccacgccgaacgatatttgcgtggcaattcgtagcgaagcggcggatgcggggatcgcgcaggcggttatgcagcagcttgaagaggcgctaaaacaactggcgcagggttcaggcagcagccaggcgttgacgcaggtgcgtcgctgggacagtgcctgtcagaaattacccgatgccaatctggcgctgatttcagtggctggtgagtatgcggcggagctggcgaaccaggcgctggatcgcaacctcaacgtgatgatgttttccgataacgtcacgctggaagatgaaatccaacttaaaacccgcgcgcgggaaaaaggcttgctggtgatggggccagactgcggtacgtcgatgattgccgccacgccgctggcttttgctaacgtgatgccggaaggcaacattggcgtcataggcgcttccggtaccgggattcaggagctgtgctcacagattgcgctggcaggggagggaattactcacgcgattggtcttggcgggcgcgatctcagccgtgaagtgggcggcatcagtgcgctaacggcgctggaaatgctcagtgcagacgagaaaagcgaagtgctggcatttgtttcaaaaccacctgccgaaactgtgcgtctgaaaattgttaatgccatgaaagcaactggcaaaccgacggtggcgctgtttttaggttataccccggcggtggcccgcgacgagaatgtctggtttgcctcctcgctggatgaggccgctcgtctggcttgtctgctttcacgcgtcactgcgcgacgtaacgcgatagcgcctgtcagcagcggatttatttgcggtttgtataccggcggtacgctggctgctgaagcggcgggattacttgccggacaccttggcgtggaagccgacgatacccatcaacatggcatgatgctggacgccgacggacatcagatcctcgacctgggcgatgatttttacaccgtcgggcgtccccatccgatgatcgacccgaccttacgcaacctgttaattgccgatctcggcgctaaaccgcaagtgcgcgtgttgctgcttgatgtcgtgattggcttcggtgcgaccgccgatcctgccgcctcgctggtgagcgcctggcaaaaagcctgtgccgcgcgttcagacaatcaaccactgtatgccattgccacggtgacaggcactgaacgtgacccgcaatgccgctcgcagcaaatcgccacgctggaagatgcggggatcgcggtagtgagttcgctaccggaagccaccttgctggctgcggcgttaattcatccgctctcgtcagccacacagcaacacacaccgtcattactggaaaacgtcgccgtgattaacatcggattacgcagctttgcgctggagctacaaagcgccagcaaaccggttgtgcattaccaatggtcgccagtcgccggcggcaataaaaaactggctcgtttattagaacgtttgcaataaggggttcccatgtttacatcagtggcgcaagccaatgctgcggttatcgaacaaattcgtcgcgctcgtccacactggctggatgtgcaaccggcttcttcacttatcagcgaactaaacaagggcaaaacactgcttcacgccgggccgccaatgcgctggcaggagatgaccggacccatgaaaggggcgtgcgtgggcgcatgtctgttcgaaggctgggcgaaagatgaagcgcaggcgctggcaatactggagcagggggaagtgaacttcattccttgtcaccatgtgaatgccgtcgggccaatgggtggcattacttctgccagtatgccgatgctggtggtcgagaacgtgaccgacggcaaccgggcgtactgcaacctcaacgaaggtatcggcaaagtgatgcgttttggcgcttacggcgaagatgtcctgactcgccatcgctggatgcgcgatgtgttaatgccagtattaagcgcggcgctggggcgcatggagcgcggtatcgatctcacggcaatgatggcgcagggcattaccatgggcgatgagttccatcaacgcaatattgcttcctctgcactgttaatgcgtgcgctggccccacaaattgctcgcctcgatcatgataaacagcacatcgccgaagtgatggatttcctcagcgtgaccgatcagttcttcctcaatctcgcgatggcctactgcaaggcggcgatggatgcaggcgcgatgatccgcgcaggcagcatcgttacggctatgacccgcaacggcaatatgttcgggattcgggtaagcgggctgggtgaacgctggtttactgcgcctgtaaacactccgcaaggtctgtttttcaccggcttctcgcaggagcaggcgaacccggatatgggcgatagcgcgattaccgaaacctttggtatcggaggtgcggcaatgatcgcagcgcctggcgtaacgcgctttgtcggtgcgggtggcatggaagcggccagagcggtatctgaagagatggcggaaatttaccttgaacgcaatatgcaattgcagatccccggctgggatttccagggggcgtgcctggggctggacattcgtcgcgtggtagaaaccggcattacgccactcatcaataccggtatcgcccataaagaggcggggatcgggcagattggcgcaggcaccgtgcgggcaccgctggcgtgctttgaacaggcgctggaagcactggctgaaagcatggggattggttgaggaacgcacaatgacgatcatccatcctctacttgccagccgtagcgcaccgaattatcgccagtcctggcggttagcgggagtgtggcggcgggcgattaacctgatgacggaaagcggcgaactgttaacgctgcatcgtcaggggagtggtttcggccccggcggatgggtgcttcgccgcgcgcaattcgatgcgttatgcggtggattatgcggcaatgaacgaccacaggttgtggcacaagggattcgtctcgggcgtttcacggttaaacagccacagcgttattgtttgctacgtattacgccgcctgcgcatcctcaaccgcttgccgttgcatggatgcaacgcgcggaggaaaccgggcttttcgggccactggcattggcggcaagcgatccgctgcctgctgaattacgccagtttcgtcactgttttcaggccgcgctcaatggcgttaagaccgactggcggcactggctgggtaaaggccccggattaacgtcaagtcatgatgacacgctgagcggaatgctgctggcggcctggtattatggggctttagatgcgcgctccggtcgcccgttttttgccttttccgacaatcttcaactcgttaccactgcggtgagcgtcagttatttacgttatgccgcgcaaggatatttcgcctcgccactcctgcactttgttcatgctctgagttgtccgaaacgtaccacagcggcgatcgattcgctgctggcgctggggcatacgtcaggggccgatacgctgctggggttctggcttggccaacaattattacaaggaaaaccatgaaaacactggttgtggctcttgggggcaacgccttactccagcgcggtgaggcgctgacggcagaaaatcaatatcgcaatattgccagtgctgtgcccgcgctggcgcgcctggcccgttcttatcggctggcgattgttcacggcaacgggccgcaggtggggctgctggcgttacagaatctggcgtggaaagaggtagaaccgtatccgctggatgtactggtggcggaaagccaggggatgattggctatatgctggcgcagagcttgagcgcacagccgcagatgccgcctgtcacgacggtgctgacgcgcattgaggtttcgcctgatgatccggcgtttttacagccagagaaatttattggtccggtttatcagccagaagaacaagaggcactggaagcggcttacggctggcagatgaaacgtgatggtaaatatttacgccgggtggtggcgtctccgcaaccgcgtaaaattctcgacagcgaagccatcgagttgttgctcaaagaggggcatgtggtgatttgcagtggcggcggcggtgtgcctgtggcggaagacggggctgggagtgaagcggtgattgataaagatctcgccgctgcgttgctcgccgagcagattaatgccgatggactggtgatcctcaccgatgctgatgcggtatatgaaaactggggaacgccgcagcaacgtgccattcgccatgccacaccggatgagttagcgccatttgccaaagccgatggttcgatggggccgaaggtaacggcggtgagtggctatgtcagaagccgtggtaaacccgcgtggattggggcgttatcgcggattgaagagacgctggcgggcgaagcggggacttgtatttcgctgtagtgatgggcaccaggcaattggcacatctagcctgatgcgatgctggcgcgtcttatcaggcctacagtcggtgttggagcggtgggccggataaggcgtttacgccgcgcccggcaatcggcacaccatgcctgatgcgatgctggcgcgtcttatcaggtctacaggcggtgtcggaacggtaggccggataaggcgttcacgccgcatccggcaatcggcacaccatgcctgatgcgatgctggcgcatcttatcaggcctacagtcggtgttggagcggtgggccggataaggcgtttacgccgcatccggcaatcggcacaccatgcctgatgcgatgttggcgcgtcttatcaggtctacaggcggtgtcggaacggtaggccggataaggcgttcacgccgcatccggcaatcggcacaccatgcctgatgcgatgctggcgcatcttatcaggcctacaggcggtgtcggaacggtaggccggataaggcgtttacgccgcatccggcaagaaaatgagcatcaattaactgaacttgctctgcgcccacatcacgccgctggcatactccggcggcagcagtgggattaaggcttccagcgtcgcggtcagacgcgatgtgtcgctgtcggtcaaattcaaatgccccactttacggcccggacggacttctttgtcgtaccagtgcagatgcacaagcggcagtttcagccagtcataattcagatcgctaccaatcagattgatcatcaccgacggattattcactactggttgcggtaacggcagatcggtaatcgcccgcagatgtagctcaaactggctgatgctggcaccgttttgcgtccagtgaccgctgttatgcacacgcggagccagttcgttgatcagcagaccttgtggggtgacaaaacactccattgccatcacgcctacatagctcagctcctgcataatcgccgacaacatctcttcagcttgcgcctgcagctgtgcgttggcctgcgggaaagcgacgctggtgcgcaaaatgccgtcctgatgcaggttatgcgtcagcggataaaacacggtgctgccatcaaaaccgcgcgcgccaaccagcgacacttcaccagagaagtttatgccctgctcgacaatacattcgccgtagcattcagcaggtaactgttcggtttcatcggcgcgtaaacgccattgaccgcgtccgtcatagccaccagtgcggcgcttaacaatcgccagctcacctaaacgatcaaacaccgcaggccactcgctgcgttcggaaagtaactgccacggtgcggtcggcaggtggagcttatcgaaaagctgcttctgagtcagacggtcggcaataatcgggaacacatcgcggttcacaaaggccggatggcgcgccagctcgcgggttaatgcagtttccggccagcgttcgatctcagcggtaatcacgctttgttgaaaaggcaccgccgccggttcagcgtccagcccgaccggccagacagcaatgcctaacggttcgcctgcctgacgcagcatacggcctaactgcccgttcccgaggacgcaaacctgtttcatgccgcacctcgcgggtccgggttttccagcacttcatcagtttgtgctttgcgccagtcattcagacgctggtgcagttctttatcatgattcgcaagaatttgtgctgccagtaacgccgcgtttgccgcgccagctttaccaatcgctagcgtacccaccggaatgccgcgcggcatttgtacgatggagtagaggctatcgacaccgctcagtgcggcgctctgtactggcacgcccagcaccggcaccagcgttttggcggcaatcatgccaggcaggtgcgctgcgccgcctgcgcccgcaataatcacctgataaccgttctcttcggcgctttcggcgaagctgaacagtttatcgggggtgcggtgagcagaaaccacttcaacgtggtgcgggacattcaggatttcgaagatttcggcggcgaactgcatggtagcccagtcgcttttggaccccatcacgatggcgacacgcgccggattattgcgggaagacatgcgtcttaaaactcctgtggtgcacaactctcggctttagagggcacagagaatagcacggaaagagtgcaaggaaaacggttgcgtaggcggaattaaccgtcagttgttgagtttttaatttgttctgcgtgttgattatgcgctctggctgaactggcaaagaatgcccatatcaacacaatgctccatggaaaaaagcaaataccgacaatcaatataaatctttctacaaaacgttggttatgggggcgggtgagtactaaataaatgagccagaaatagactatccaggaaatgaccgccgcagctaccagtgacaatgcgccaaaatagaagccgacaagaccgaaccagctaatacacagtggcgctcctgccgtaagggcgatgccagaaatcaaaaatccgttgcagcgttgcataataatattccctgttgttatttcactcagagattattaccttgctgattttaaaaaagatatacaggttgcgttagttcggtgctttttcagaatctgtccattcgtggtcagaaaggaaaatggattagctcaacgtcatctgccgtgactttcaccatcgaaccttctgtatgccaggcacccagtaccacgcgaaaagccgtttgctgattggcgataagttcatgcaccgccgggcgatgggtatgcccgtggatcagccattgcacttgatgtttttccatcgcactgaccaccgcgttttggttaacgtccatgatcgccagcgatttactgctgttggcttctttgctgttcgcgcgcattcgcgcggcaatgcgtttgcgcacaaacaacggcagggcgaggaatagcgtttgcagccagggtttgtggactttggcgcgaaaagcctgataacccgcgtcatcggtgcacagcgtgtcgccatgcataatcaacacccgacgaccataaagttcgagcaccttttcttccggcaataacgtcatgccgctttcacgggcaaagcgtttgccgagcagaaaatcacggttgccatgaatgaaataacagggaacgccggaatcggacaccgctttgatcgctgccgccatctggcgatggagtgggttgggatcgtcgtcgccaatccatgcttcaaacagatcgccaagaatatacagcgcgtcggccttgcgggcttcccccgctaaaaaacgcagaaaaccggcggtgatcgccggttcttccgcgcagagatgaagatctgcaataaagagtgtcgccacgattactcgctaacggtcacgctttcaatgataacgtcttcttttggcacgtcctggtgcataccgctacgaccggttgcaacacctttgattttgtctaccacgtccatgccttcaaccacttcagcaaacacgcagtagccccaaccttgcaggctttcgccagagaagttcaggaagtcgttatcaaccacgttgatgaagaactgtgcagttgcagagtgcggtgcctgagtacgggccattgccagcgtaccacgggtatttttcagaccgttgttggcttcgtttttgatcgggtctttggtggttttttgcttcatgccaggttcaaaaccgccgccctgaatcataaagccgttgattacacggtggaaaatggtgttgttgtaaaaaccttcgcggcagtagtccaggaagtttttaactgtttcaggtgctttatcgtcaaaagttttgatgacaatatcgccgtgattggtgtggaaagtaaccatttttgcatcctgttccgtttgattggtgcttcaacccggttcgggtcatatatagggtggtgttatagcataaccgcacgatcggatcatcacgcaatgtatgctgattcgcgcgggaaatatgggtattatacgcaactcaattacccacacatgtctaaacggaatcttcgatgctaaaaatcttcaatactctgacacgccaaaaagaggaatttaagcctattcacgccggggaagtcggcatgtacgtgtgtggaatcaccgtttacgatctctgtcatatcggtcacgggcgtacctttgttgcctttgacgtggttgcgcgctatctgcgtttcctcggctataagctgaagtatgtgcgcaacattaccgatatcgacgacaaaatcatcaaacgcgccaatgaaaatggcgaaagctttgtggcgctggtggatcgcatgatcgccgaaatgcacaaagattttgatgctttgaacattttgcgcccggatatggagccgcgcgcgacgcaccatatcgccgaaattattgaactcactgaacaactgatcgccaaaggtcacgcttatgtggcggacaacggcgacgtgatgttcgacgtcccgaccgatccgacatatggcgtgctgtcgcgtcaggatctcgatcagctgcaggcaggcgcgcgcgttgacgtggtcgatgacaaacgtaacccgatggacttcgttctgtggaagatgtcgaaagagggcgaaccgagctggccgtctccgtggggcgcgggccgtcctggctggcacattgagtgttcggcaatgaactgcaaacagttgggtaaccactttgatatccacggcggcggttctgacctgatgttcccgcaccacgagaacgaaattgcccagtccacctgtgcgcacgatggccagtatgtgaattactggatgcactccggtatggtgatggttgaccgcgagaagatgtctaaatcgctgggtaacttcttcaccgtgcgtgacgtgctgaaatactacgatgcggaaactgtgcgttacttcctgatgtcgggtcactatcgcagtcagttgaactacagtgaagagaacctgaaacaggcgcgtgcggcgctggaacgtctctatactgccttgcgcggcacagacaaaaccgttgcgcctgccggtggcgaagcgtttgaagcgcgctttattgaagcaatggacgacgatttcaacaccccggaagcctattccgtgctgtttgatatggcgcgtgaagtgaaccgtctgaaagcagaagatatggcagcggcgaatgcaatggcgtctcacctgcgtaaactttctgccgtattgggcctgctggagcaagaaccggaagcgttcctgcaaagcggtgcgcaggcagacgacagcgaagtggctgagattgaagcgttaattcaacagcgtctggatgcccgtaaagcgaaagactgggcggcggcagatgcggcgcgtgaccgccttaacgagatggggatcgtgctggaagatggcccgcaagggaccacctggcgtcgtaagtaattgcgctattgccggatgcgagttttcgcatccggttatcgcctgcgccaccacaacattcccatcagtagcatccccggcaaccacacccacatcaattcagaaataatcacctgatgcccgtacggcgtggtgtaacgagacaatgcaaacggcgcgactttaatcacctgccagggagcgaaaaagcgttcatctgaccacggccacagccagccaacccctttaccgccagtggttaccgaatccagcaagctgtgcgatagcaacgagacggttaaaaacagccagcagcgaatcagcccagccctgaaccatcgacgtccaatcagcacacataacagcgggacaacaaacgcaaacaccagcgaatgggtaaacccgcgatgaccaaaaacattgccgtaagcaacgccaaatttaaacgacaatacatcagcatcgggcagcatcgccaggatgattccggcaaataacagacgcggagggatggctttcgaacccaaccctaaaccaatgcataggagaacggcggcgtgcgtaataacggttggcatgatggtcgcttcggcaaaatgtcgatgctatcagcatggatgaacggggcgtagagggcaaaagtctgaaaagagaaccggcctgttgatacaggccgggaaagggatcaggcaacaacctgtacgctgtgacctgcaaaactcactgtctgaccggcgacgattttgcagcgtttacgcgtttcaaccgcaccgtcgactttcacctggccttctgctatcgcgattttcgcctgcgcgccgctttcgctccagccttccagtttcagcaagtcgcacagctcaacgtgcggatgtttacctaaagaaaatgtcgccatgttactcaccctgtggatcatgatattcaacgcacgcctgtagcgtgttttcaatcagcgtggcaaccgtcatcgggccaacgccgcccggaacaggcgtaatgtatgaggcgcgtttagccgcgtcttcaaacacgacgtcgcccacaactttgccattttccagacggttgatgccgacatcaatcacaattgcgccttctttgatccagtcaccaggaataaagcccggcttgccgacggcaacgatcagtagatcggcattttctacgtggtgacgcagatttttagtgaaacggtgagtcacggtggtggtgcaacctgccagcagcagttccatgctcattgggcgaccgacgatattcgatgcgccaatcaccacggcgttaaggccgaaggtatcaatgttgtaacgctcaagcagcgtgacgataccgcgcggggtacagggacgcagacgtggcgcgcgctggcacagacgaccgacgttgtaaggatggaaaccgtccacgtctttgtccggatgaatacgttccagcactttgacgttatcaatacccgccggtaacggcagttgaaccagaatgccatcaatggtgttgtcggcattcagcgcatcgataagctccagcagctccgcttcgctggtggtttccgggaggtcataagagcgggagacgaacccgacttcttcacaagccttgcgtttgcttgcgacataaatttgcgatgcagggttactgcccaccagcacaacggccagtcctggtgcccgcagtccggctgcaatacgcgcctgaactttttgagcaacttcagagcgcacctgctgcgcaatcgttttaccgtcaataatctttgctgccatcagagagaggattccatctgttacgtaggtcgaaggggatgcgtctattttgtcagaagcgtggcgcgctgtcagttttcgttttctgaaaagtaaaaccttctgtacctggctgattcacacctatcatgataaccgtcgttggtttgccgccatagtgagctacatcagatgcggtcgtacacttgttcagcaactggttcaaaagccattgactcagcaagggttgaccgtataattcacgcgattacagcacaccgtggtatcaatgcgcccttagctcagttggatagagcaacgaccttctaagtcgtgggccgcaggttcgaatcctgcagggcgcgccattaaaattcaatcagttacgccttctttatttcttctataattccagagtgggacattatcaccaaaaatgtcgtctattttcctcgcgtgctcagtcaaatgattaggcgcaaggtgagcatatctacgaaccatttctctggactcccatccgcccatttcctgaagcactgataatgggacgcctgacggaatcaacctgcttgcccgggtatgccagaggtcatggaaacggaaattttcaactcctgcacgacgacaagctgatagccatgctgtcttgctgtcaatgcgcatcttcctgagcgcaggcattgatgttccatctgctcgcttagccgccctggtatgtacacccacatttgtgatgcttgcctgtttgatcacgcaacactttagaggcggtatcgttcagcgccacaccaatggcgcgatttgatttgctatcttctggattcaccctggcaacttgtcgctgcatgtcaatctgttgccactccagatttatgatgttcgactttctcagaacagttaccagcgcaaacttgacgacagatttcagtggcttggggctctcatcaatcaggcgtttttcctgattcttttgtaagtctcttgtgccattccacctcatacaggtttgcctgcaaacagtaccgatattgcaccgccagatattccggctggcttcgtggttgttttcaacagtgatgaggcatcgtggcatctcgttgaagaccatcggggtaaaacggtttatgacgtggcatcaggggacgcgttatttatttctgagctcggtccgttaccggaaaatgttacctggttatccccggcaggggagtttcagaagtggaacggcacatcatggataaaggatacggaggaagaaacctcgttgctggaagcctgtaagatgtatcgggtgttgctgaaccgagttgatacatcaactgcccctgatattgagtggcctgtgaaccctgtcagagagtaatcattgggattatgccgcagcacgtcgtgcgcaagaacgtgctgcggctggatgctattttttccctgaagcggaaaacattactacagtacctttaaccttggttttaacattctcgaaatgctctgagagtatatgtgttaagccttcttcggaatcttttgtgtttgaaaagatgcctttctgattgtaaatgcgcatcagtttttgaccgaagctattgtgcacaacgccgtcaccaagaattgtggctccgtatagagttccatcgtcagttaaggcctgcgctgcattgcgtattacacagctttttgtagatatatttccaggcaggcagtgaagaaggtaaaacatggaaatggaatcaaattgaccatgtaacgccgcgggataaggatcaaaaacatcatggctaattttatgtttaatttttgattccccagcccttgtcgatgccgcgttcaggctagcttcgttcaaatccattaaagatatcagactactctcaggtacgtgagtaaggtaaaacccagttccaacgccaatatccagatggttgttacctaaatgttccagaaagtgtggaagaaggtgttcctttgtaggacatctccatgcaagccgatttgatacacccaaaacccaccagtcataaagctttagggtaagtggtgtgtaaattttagccccatcatctgtgttttttttcattagtttcaccatgttatagttttatttgtgaattaaatcaattatagcgatgaattacaaggggttaaatgatgccacggcataacgaatttgaatatattgagtcttgtgttgcggtaagaggttacacgccaggacgcaggttaaatgcttacaagattaggggatattgtttgcttttaacggtaaacaaattccccggggctatacaataccaccggggagaaaatctatttaacgttgttaaaaggtgtacttaagaccagcagtagtgatgaagttatagttttctatgcctgcaccatttttgctgtagtctgaagtgttatcattgtgatcataaagtgaagtattaccttttttattcgtaacccgattccatgcgccttcaacataaacttttgcgttaggtgttacgtaataacctgcattgactgcaacagaatagtaattggtaatgactccaacttactgatagtgttttatgttcagataatgcccgatgaccttgtcatgcagctccaccgattttgagaacgacagtgacttccgtcccagccttgccagatgttgtctcagattcagattatgtcgctcaatgcgctgagtgtaacgcttgctgataacgtgcagctttcccttcaggcgtgattcatacagcggccagccatccgtcatccataccacgacctcaaaggccgaaagcaggctcagaagacgctccagtgtggccagagtgcgttcaccgaagacgtgcgccacaaccgtcctccgtatcctgtcatacgcgtaaaacagccagcgctgacgtgatttagcaccgacgtagccccactgttcgtccatttcagcgtagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtaccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattacctagtaattttggtctttgactttactgcgataagtgattctttttcctgggtcatagtgctcatcgttatcagatgcttccacccagccgctgtatttaaatgtgccacctagctcaaaatcttcataacgataacttccagtcaagccaatgtagggcattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgtctactttcatccgtccaggttccggggttactggaatccatccagtcccgatcgaccatattgccacctcggctaccgagagttgtccagccagcagccccgatagatatctggggcatcaaatcccaattaattgcccctttaataattgcagcgttattgaatttccagtcaagttgactgacttttcggcctccttcttcggctagataaacacgctcttttgtttttccgctcagagttccaagactaatgtccgcatttatgttgtcaggagtaaacgataaagtctcggtagaagcaaaagagctgatcgcaataggggttgtcaggactattcccagaagtttcgcccgcataaaaggtctccattcaatcgttttaatgattgagtatgtattttttatatctaacttaatgagtcaattgtatattgccccactgtttatattttgtttaacattgaatttttgtcacaatgcactgtcagttttttagtttaattgtctgtttgtgttttgcattgtggttttatgggctaattattttttttctttgtggagtttttatctgttcaagtgccatgcctttagatgcatattagcgatcatagcatgaggtttatcctcaattgctgtgttttttagtataaaaaagaggaacaaaactgagacacataaggcctcgcaatggcttgcaaggttttacatattttgaggtggtggaacgtgtgaacgcagagatggcgcggtaatttgttgatttaaaatgtcgttcctggagtttctaagtcgtggctacaggttcgaatcctgcagggcgagccatttcctcgccatttatttgttcccttttacaaattacaccatcactttgttgtcgcggttttgctaaataattggaacacgtcagacgaataaaatgaaaacagaaattctgctaaacaattcatcttgccaggattttgattaggaaagtgaaaaggaaaggagcaaactaagttgctccctttaatcattaatactcaaggatactctgcgcgacgggcaaatagcgcagagagaaatagagcgtgtctttaccgcaagaggaacgtttcgctaacagcgaggcgatctctgcatccggtttcggtttcgctgtaaacgttttacctttaccagcgacaaacagttcataaacaatgccgcttgctggggcggaactttggcaatcggcgctggcctgtagataacgttcacgctgttcagcggtcagtttatccacgccgctgccatcctgtacccagacattaacaccggttgctttaacttgttccagcagttggcgatagccatctggcgacatgtttccggcgaaaaaactactgatataaaccggttttgctgaaacatcgctaatcaaccgctgcgcgttgtttaaccatgttagcaaaggctgacgggcggcttcgctgcgccagttcaggtcgtcaatttccgcgctgatgtaccagccatccggcgttacgccaggcacggcgctccataatctggcttgctggagatcggcagccagcaggcgattaagatagctttccagcgctgcggacgactgtttctggtgcataaaaaattccggatcggcgttcagcccgacaatcagcttcaggccagcctgttgcgcagctgcggcacgcttaaacaataacgcgcgctgttctggctgggtgaatgcatcgccgtaacgggtccattgcaaaaccagggtatcgaagccttgcaaacgtaactgactcatcagcccctgccactgggtatcggtaacctgactatcacggttttgtggttgccagataatacctttcatcgcaaaggaaaaagggctgaccaaaagcagtgtcaacaatacgaaaatgaacttacgcatttaccagtgcactccaatggtgagaaacgcgttgttgcgctctccgttacgttgattaatcgccttaaaggtatgttgatattcgacgccgagactgactttgtgcggccaggcgtcgtagtgcgtctcgccggtccagatattccagcggaccccgacaccgccaagctgcgcgccctgagtgcctttatcacgataaccgttgtcctgaaggtgagcataaggctcaatagtctgtccgttcgccaccttctgatgccagcttacgcgataatctgccgtccacgcctgaatatcctggcggacatattgcgccgcatcgaggtacaggttttgggcaaaccagcctgaaccgttcgggtgccattcgtcgctgtatttgccgccattaaagaatgaggcgctggcgcgcagcatggtatcggatgcgccattttgcccgttcagcggcaactgctgttcgacggcgaggaaaaagatctgatcgcgcagcggcttccagcgcagaccggtgccggacatcggatttttcaccggcatcatcaccccgttttctccggtatcggcaaagacgcggctataaactgagagcaggtcgccttccagcagcatattgcgtccgatgcggtactcggcttccagttgcccgtagctacgatagcttttccctggcgctgcgccgccgacattattgttagcggtactcatcgcgccggaacgcaagccgatggaagaatcgaaactgaacgtccagcggtgaccgacctcctcatgcagacggcggaaattgaagcgttgctgattttgctctggggtcagtggggttatcagcgcctgattatcaatgtcatcaatcaccagccgggcgtagtgctgcgtcgcaggcatgtcatccagacgctggttcacgtaggccagttgtcggataagtgccggatcgtccggtagccctttatgcgcctgttcgagcatttcccgcgactgtgcgatatcaccgctatcccacaaggcgtaaccaagcgctgcctgggtgttgctattattcggctccagttccagcgcggcgcgcaaatcactcaccgccgccgggacattatgacgttggcgataaattgtcgcccgcgcaacgtaagcgttggcagaaggcgcaatattgattgagcgcgtgagatcgttcagtgcgagttccggctgaccaggaatgtaacgttgcgcatgcagccaccagtagagggcattgtttcccagcccacgttgttctgcctgctgaagccagcgatcgcgagccgcaccatttcctgccgcctgggcggtattggcagcagcaagcagatcctcattgctcatgtcgtgaagactgattttctgccaggccgccagtgcggtggcgtagtcctcaacctgatacgcctgataggctaccgcacgatgttgccaggcgttcggttgtcgttgttcggcctgaagccatgcatacaacgccacaccgggtagcgtgtcccgataacactttgccagacggttccaggcggcggcatcgtaggaaggcgacatatcgcccagcaagcgaactattgccgggcaattatctgcaatacccggcaactgactttgccactgacgttgctccgccagcggtaagggtttcgataaaatcgccaccttcgccggagttgccaggtaaggatgactttccagcagagacgccagtcgcgccattaaagtctggctgacacgcgcatcgccctggaaaggatagcgttgcagcaataaatcggcagcttcgcgtgactgttcgttctgcatcagttgccaggtcagttgatccaggcgggtaagatttgccggttcttgctgatacagcaatcgtgccagacgcagagcttcagccttgttacgggtcgctacgctaacggcataacgctcctcaagcatttcattggcggggagggtggcgagtagtttttgcgctgcgtcgtactgaccttcttttaacagcaccggtagcgtcacgccaacaacatactggcggttatcggcaaactgcaccgtataattcgccaacgcctgaacggggttggcgctgtatttagataacagatagagccaacttttctcttgtgcgtccgtggtaaacagcggcttattttcaatgagataatgctggaggcgtgctttttcgccacgataagccagcgcggtcgcgtaagtaatatatgactgaggatcggtgaagatctcctgtgattgcagcgccaggatccgatcgtccagctgcccggcaagaagcacgtcaaaccactgacggcgttctgccgcgcttaatgtgttctgctggcgtgcttcattgtatagcgtatctgcctgggaccattgtttcaggtagattgcgcgttgcagcagatcggttcgcagcgtttttccttccggcgatgcagcaaacgtcgcatcgttcagttgcgctctggcgacaggtaattgtgccagccgcagggcattctgcccgacttcactgcgacaacgcagggtcggcgcagcatcgcacgctttttgctgggcaagcagttcttcaacagtcgtaacgcttttcacttcaacaggaatagccgccagactgcgctcaagccgatcatctcctgggtgacgtttcagttgatcctcaagcaacagccgcgcccggtcatcatgaccaaaatggcgataggcttccgcaaggtataaagtcagcggaatattatccggcacctgctggtgtatatattcaaattcgcggatggcggttgcttcgtcgttatttttctgtgccttcagcgccttatcgagacggggataaataacaaaatggcgataatcgctcagccccagctcttctgcgctggtgccgatattgtctgcgagtgcgctggtactcaataaagacgtcagcagtaaaccagaccatccgatgacgcgattaaggttattctccttcattttcggactccagttgtgcaacctgttcagtgtttaaacctgctttgagtaatagtgattgcatcgaaacttgtaattcgcgttgaattgtcaggacgcgatccaacgtttcctggctgataacgccttcggtgaccaaaaacttgccgagcggcagagaactgcgttcatggcgcaataacaacacgttaattgctgaacgattaatatgaccgagcgtggtcagtatttctgcgaacaggaactgatgcggcacatattgccgccagatttcaccggcctgctgttccgtgagccactgatgctgaactgcattgtacaacattgcccgcggatcgtgaccgcgtcggcgtgcataccagtggcgtaatccggtgacaatttgtccccgcagaacaatgacgtaacgcactttgcgtccgactttacgcgtcagggccgccagcgaaaccgggtcaataccatcttcactgccgacaattaactcatcattgtccagacgcagcggcagtaccgcataatgcaacgccacggaggccggcatttcggcaatcagcgaggaagggatctgctaggcatcgatggattcccacgccacgccgttttgctctgccagcgcctgtgccagttgctcggcgctaatcagcccctgcatcagcattgaaccgcccaggcgtaggccttcgacgcgattacgcagtgctgtatcgagttgttcttcagtgatgacctgattttccagcaggatttggcctaacggacgcaacgagcgggtatcgccagtcacgctggggaagtcatgcgttgttttatcccacgcgacacgacgtggatcgccgtgttgaagtacctgttttaacgcgcgccagttggccatgaagttaatcaggttgccccagaaaagacgcaggacagatagcagcccctgcgtcaggccgtagtagccagtaacgaaaatcacccgctgcacgatgcggttaatcatcaagccaaagtttagccacagcagagtcattaaccatgcgctgccgctgaaaatagaaaggaaatgccaggcatcgggccacaaactttcatacgccagcaacagcaaaagctggatcatcaccagcatcgcgaggaagctgacaaagttactgattgcccctttgcggtcgcgccagagaaagtagttcagcgtcaggctggaggtccatttgtgggttttaaagccctggaaaacaatgccgatgatccagcgagatttttgccgaaccgcagtcgaaaaggtatcggggaaatattcgcgcacgcagatcatgtttgacgtccgtgcatgctgtaaaaatttacgctgctcgcgttctttggcttcgtccaccaccggaaaacggacaaaaatttccgtcatacctttctctttcaggcggaagccaatgtcgtaatcttcagtcagactctgcacgtcgaaagcaataccgtcaccgtcagctaacagtgcggtcacggcgcggcggctgaaacaggtgccgacgcctgcgctgggcacctgtccggcgagggcttcacgcaccggaacatctttgccatgcagttctgaaaactcatcaatgtaggtcatgctggtgaagtgcgtccattcgcgttcgaacggatacactgggatctgaatcagatctttacgctcgaccagatagttgaacagacgcaattccatcggtgaaatcacatcttcggcgtcatgcagaataaaaccagcaaaagcgaaattggcgctacgttcaaattgggtgatggcgtccagcacgttgttcagacagtcggctttgctggtggggccaggacgcgcgcagactaccttatgcacgttcgggaagcgagcgcacacttcgtcaacatcacgctgagtatcggggtcgttggggtaggtgccaacaaagatatgatagttttcgtagtcgagcgtggtcgccgccagctcggccatattgccgatgacgcccgtttcattccacgccggaaccataatcgctaacggtttttcatctggtttatacagttcgcggtaactcattcgcgggtagcggcgataaacactcaacttgcgtttaatgcggcgtacccagtagacgacatcaataaaaaaatcgtccagcccgctgatgaacataatgaccgctaacgttatcgcgattacttttaagccgtagagccaggtagcaaaaacatcaagaagccagtccacacaaaaaccttacattaacgctggttatgtttagggtggcgtatattaaggttttttatgaattgtgacagctttttatcattaataggtattactattgcggcatgttatttttacactggttataaaagttgccgtttgctgaaggattaagcgggtaatatgataacaaaccttgtcccccgcacatctgacgttactgcaactgtgcctttatgcgcgacaacaatcgatttcactatcgccaggccaatgccgctaccttcgccttttcgctggcgggaaggatcaacgcggtagaaacggtcaaacaatcgcggtaagtgttcgggcgcaatgggcgtaccggggttttcgacggtaacttgcaccaggtgatcgaccgtctggcagcgcacgacaattgtctctccggttggcgtataacgcagggcattagaaagcaggttgcttaacgcccgacgcagcatcagcggatcgcccgcaacctgacactcgtcgccaacaaaccgcagctccacgccgcgatcttctgctaacgcctcgaaaaaatcgaacactttgccgacttcatccgccaggttgagcattttcttttcggggattagctggttgttatcggcctgagcgagaaacagcatatcgctgaccattttcgccattcgcgtcagctcttcgagattagagtagagcacatcttccagctccttctggctgcgcgactggctgagggcgatttccgtttgcgtaatgagattagtaataggtgtgcgaatttcgtgggcgatatccgctgagaaattggactggcgggtaaagacatcctcaatacgctcgatcatatggttgaacgacagtaccagctgttccagctcaatgggcacggtctgcgggtcaaggcgaacgtcgagatctttcgaggtgatattctggatttgacggctgacgctgcggatcggcgcgtgacctttatgtaccgccaacagcacgataaagacgatcaggatgctgattaccgatgcggtcataataagtttattcatcaaatcattgatgtaatgaagatgaaaatcgatcgaaagcgcgatgtagagcgtataaatcggtttgccgtcaaccagcgggccaaccggcaagttaatcatccgccagttgctgtgttccatatgcccgtgaccgtgccctggcatcatcatcgttgggccggaaaggagatacacctcgccagcctgcgcgtctttatcgggtatggcgtcacgcgtaaactcgcggatatccggcgcacctggagagtgatacaccgttttaccgtggctatttgccagggagatcaacacattggaataaccactgacgatatcttccagcgtcattaagcgtcgggcttgcgtttcgtcagggtgattaagtacccgttcaagggtggcgctaatctcctttaaatcattaatatcctgctcggcaaaatgcacttttaccgagtggatcatgatccatgcaaaggcgaaaaacgccgcgatggtggcgaggctgataaaaaaggtcaggcgggttgccagcgaaaacgggcgctgaaatggcttactgaccatccggcacctctagcatgtaacccacgccgcgcacggtctgaatcaactttggctcaaagtcgttgtcgattttgccgcgcagccgcttcaccgccacatcaatggcgttggtatcgctgtcaaaattcatgtcccatacctgcgaggcgataagcgagcggggcagcacttcgccctgatggcggaggaaaaactccagcagagtaaattctttactggtcagagtgatgcgcgtgccgctgcgggtgactttgcggctgacgagatcgaccatcagatcggcaacctgaaactgactttcgataatcaccgccgccccgcgccgcagtagagtgcgcacccgcgccagcagttcagcaaaagcgaacggcttcaccagatagtcatccgcccccaactccagccccttgacgcgatgttcaatggtgccaagcgcggtaagcaacagaatcggcatccccttattggcggaacgcaacatgcgcacgatatcccagccgttcacgtccggcagcataatatcgaggattatcagatcataatcaccggtcatcgccagatggtagccattcagcccgttgtcggccaaatcgaccacaaaaccggcttcggttaaccctttggtcaagtattctccggttttcttttcatcttcgacaatcaacagtttcatatttcctccgcatgttgcccgggcaattctagagtagcgggatcagatggcaatcgcttattggcaaaatgacaattttgtcattttcctgtcaccggaaaatcagagcctggcgagtaaagttggcagcataaaatcaccagaaattatgagcctatgtctccttgtaaacttctgccattttgtgtggcccttgcgctaaccggttgttcactggcaccggattatcagcgtccggcaatgcccgtgccgcagcagttctcactcagccagaacggcctggttaacgcagcagataactaccagaacgcgggctggcgcaccttttttgttgataatcaggtgaagacgctgattagcgaggcgttggtgaataaccgggatttgcgcatggcggcgctgaaagtgcaggaagcgcgggcgcaatatcgtctgaccgatgccgaccgctacccacagctcaatggcgagggcagcggcagctggagcggcaatcttaaaggcgattcagccacgacgcgggagttctcgactggccttaacgccagctttgatctcgattttttcgggcgcttaaagaacatgagcgaagccgagcgccaaaattatttagccactgaggaagctcagcgcgcggtgcatattttgctggtttctaatgtcgcacaaagctatttcaatcagcagctggcgtatgcgcaattgcaaatagccgaagaaacgctgcgtaattatcagcagtcatatgcgtttgtcgaaaaacaactgttgaccggtagcagcaatgttctggcgctggaacaggctcgcggggtgatagaaagtacccgcagcgacatcgctaaacgtcagggggaactggcgcaggcaaataatgcattgcaactgttattgggaagctacggcaagctgccgcaagcgcagacagtaaacagcgacagcctgcaaagcgttaaattaccggcgggcttgccgtcgcaaatcttattgcagcgccctgatattatggaagctgaacacgcgttaatggcggctaatgccaatattggtgctgcgcgtgcggcatttttcccgtctatcagcctgaccagcggaatatcaaccgccagcagcgatctgtcgtcattatttaacgccagcagcgggatgtggaattttattcctaaaattgagatccccatttttaatgccggacgcaaccaggccaatctggatatcgccgaaattcgccagcagcagtcggtggtgaattatgaacagaaaatccagaacgcctttaaagaagtggcagatgcgctggcattacgtcaaagcctgaacgatcaaatcagcgcccagcagcgttatcttgcgtcgctgcaaattactttgcaacgggcgcgggcattatatcagcacggcgcggtaagttatctggaagtgctggatgccgagcgttctttatttgcaacccgacaaactttacttgacctgaattatgcccgtcaggttaacgaaatttctttatataccgccttaggcggcggttggcagcaataatttttaactccaggagagaataaatgaaaaaagcactgcaagtcgcaatgtttagtctgtttaccgttattggctttaatgcccaggctaacgaacatcatcatgaaaccatgagcgaagcacaaccacaggttattagcgccactggtgtggtaaaaggtgttgatctggaaagcaaaaaaatcaccatccatcacgatccgattgctgccgtgaactggccggagatgaccatgcgctttaccatcaccccgcagacgaaaatgagcgaaattaaaaccggcgacaaagtggcgtttaattttgtccagcagggcagcctttctttattacaggatattaaagtcagccagtaacccaggtttaatgagatgaaaaaaatcgcgcttattatcggcagcatgatcgcgggcggtattatttctgcggcaggttttacctggtttgcaaaggctgaactgcccgcagaaaaaacgtcgaccgcagaacgtaaagtcttattctggtacgacccgatgtatcccaatacgcggttcgataaaccagggaaatcgccgtttatggatatggatctggtgccgaaatatgccgatgaagagagttctgcatctggtgtgcgcattgacccgactcagacgcagaatctgggtgtgaaaacggcgaccgtcacgcgtgggccgctgacttttgcccagagtttcccggcaaatgtcagttacaacgagtatcagtatgccattgtgcaggcccgcgccgccgggtttatcgacaaggtgtatccgcttaccgtgggcgataaagtgcaaaagggcgcgccgcttctcgacctgaccattcccgactgggtggaagcgcagagtgagtatttactgctgcgcgaaaccggcggtacggcgacccagactgaaggcattcttgagcgactgcgactggcgggaatgccggaggctgatattcgccgtctgatcgccacgcaaaaaatccagactcgctttacgctcaaagcgcccattgatggcgtgatcaccgcgtttgatctgcgcgcgggaatgaatatcgccaaagataacgtggtcgcgaaaattcagggtatggacccggtgtgggtcactgctgcgatcccggagtccatcgcctggctggtgaaagatgcctcgcagtttacgctcaccgttccggcgcgacctgataaaacactcaccatccgcaaatggacgctgctacctggcgtggatgctgcgacccgcacgctgcagttgcgtctggaaatcgacaacgccgacgaggcgctaaaaccgggcatgaacgcctggttgcaactcaataccgccagcgaaccgatgctgctcattccgtcacaggcgctgattgataccggcaacgaacagcgggtgattaccgttgatgctgacgggcgctttgtaccgaaacgcgttgccgttttccaggcatcgcaaggcgtcaccgcgttacgctctggtctggcggaaggtgaaaaggtggtttccagcggcctgttcctgattgattctgaagccaatatttctggcgcactggagcggatgcgctctgaaagtgctacccatgcgcattgagggaatagccaatgattgaatggattattcgtcgctcggtggcgaaccgttttctggtgctgatgggcgcgttgtttctgagtatctggggcacctggactatcattaacacgccagtggatgcactgccggatctttccgatgtgcaggtgattattaaaaccagctatcccggtcaggcaccgcaaatcgttgaaaatcaggtgacttatccgctaaccaccaccatgttgtcggtgcctggcgcgaagactgtgcgcggtttctcgcagtttggcgactcttatgtgtatgtcattttcgaagatggcaccgatccgtactgggcgcgctcgcgggtgctggagtacctcaaccaggtacagggtaagctgcctgcgggagtcagcgccgagctggggccagatgccacgggtgttggctggatctatgaatatgcactggtggatcgcagcggtaagcacgatctggccgatttacgctcattgcaggactggtttctcaaatatgagctaaaaaccatccctgacgttgcggaagtggcgtcggtgggcggtgtggtgaaagagtatcaggtggttatcgatcctcagcgcctggcgcagtatggcatcagtctcgccgaagtaaaaagcgcgctggatgcttcaaaccaggaagcgggcggttcgtcgatcgaactggcggaagcggaatatatggtgcgcgccagcggctatctgcaaacgctcgacgactttaatcacatcgttttaaaagccagtgaaaatggcgtgcccgtttatctgcgtgatgttgcgaaggtccaggttggcccggagatgcgccggggcattgccgaactgaacggcgaaggcgaagtggcgggcggggtggtgatcctgcgttccggcaaaaacgcccgtgaagtgatcgccgccgtgaaggacaaactggaaacgctgaaaagcagtctgccggaaggcgtggagatagttacaacatacgatcgcagccagctcattgaccgcgccattgacaacctcagcggcaagttgctggaagagtttattgtggtggcggtagtctgtgcgctgtttctctggcatgtgcgctcggcgctggtggcgattatttcgttgccgctggggttgtgtattgcttttattgtcatgcactttcagggactgaacgccaatattatgtcgttgggtggcattgcgattgccgtcggggcgatggtcgatgccgctatcgtcatgatcgagaatgcgcataaacggctggaagagtggcagcaccagcatcctgacgccacgctggataataaaacgcgctggcaggtgatcaccgatgcatctgttgaagtggggccggcgctgtttatcagtctgctgattatcacgctgtcgtttatcccgattttcaccctggaagggcaggaggggcgtctgtttggcccgctggcgttcaccaaaacctatgcgatggcgggcgcggcgctactggcgattgtagtgatcccgatcctgatgggctactggatccgtggcaaaattccgccagaaagcagtaacccgctcaatcgctttttgattcgtgtttatcatccgctgttgctgaaagtactgcactggccgaaaaccacgctgttggtggcagcgctttcggtgctgacggttctctggccgctcaataaagttggcggggaatttttaccgcagatcaatgaaggcgacttgttgtatatgccatcgacgctgccggggatttccgcagcggaggcggcgagtatgctgcaaaaaaccgacaagctgattatgagcgtacctgaagtggcgcgggtatttggcaaaaccgggaaagcggaaaccgccaccgattcagctccactggagatggtagaaacgactatccagcttaagccgcaggatcagtggcggcctggcatgacgatggacaaaatcattgaggaactggataacaccgtgcgtctgccggggctggcgaatctgtgggtgccgccaattcgtaaccgtatcgatatgctctcgactggcattaaaagccctatcggcattaaagtttccggcactgtgctggcggatatcgacacgatggcggagcaaattgaagaagtggcgcgaacggtgccaggcgtggcttctgcgcttgctgagcgtctggaaggtgggcgttatatcaacgttgagattaaccgtgaaaaagccgcgcgttacggtatgacggtggcggatgtgcagttgtttgtgacttctgcggtgggcggggcgatggttggcgaaacggtggaagggattgctcgttatccaattaatctgcgttatccgcaaagctggcgcgatagcccgcaggcactgcgccagttgccgatcctgacgccgatgaagcagcaaatcaccctggcagacgtggccgacgttaaagtctctaccggaccgtcgatgctgaaaaccgagaatgcgcgcccgacgagctggatttatatcgatgcccgcgatcgtgacatggtgtcggtggttcacgatctgcaaaaagcgatagctgaaaaagtgcagttaaaaccgggcaccagcgtggcattctccgggcagttcgagctactggagcgcgccaaccataagctgaaactgatggtgccgatgacgctgatgatcatcttcgtgctgttgtatctggcgttccgtcgggtgggcgaagcgttgctgattatcagcagcgtaccgtttgcgctggtgggcggcatctggttgctgtggtggatgggctttcatctttccgtggcgacgggcaccggttttattgcccttgccggggtcgccgccgaatttggcgtggtgatgctgatgtatttacgtcacgccatagaggccgagccgtcgttgaataatccgcaaacattcagcgagcagaagctggatgaggcgttatatcacggcgcggtactgcgcgtgcgcccgaaagcgatgacggtggcggtgattatcgctggtctgctgccgattctgtggggaacaggagcagggtcagaggtgatgagccggattgccgcgccgatgattggcggcatgatcaccgcgcctttgctgtcgctgtttattatcccggcggcgtataagctgatgtggctgcaccgacatcgggtacggaaataaaagcaggataccccgtttaaccgtgtggattgtgtcttgcgacgatgggcactaaatgttaaaaggtgcccctcaacaaaaaagacacacaggggaaaggcgtgaaaaacgcgtcaaccgtatcggaagatactgcgtcgaatcaagagtcgacgcttcatcgcggattacataaccgtcatattcaactgattgcgctgggtggcgcaattggtactggtctgtttcttggcattggtccggcgattcagatggcgggtccggctgtattgctgggctacggcgtcgccgggagcatcgctttcctgattatgcgccagctcggcgagatggtggtcgaagagccggtatccggttcatttgcccactttgcctataaatactggggaccgtttgcgggcttcctctctggctggaactactgggtaatgttcgtgctggtgggaatggcagagctgaccgctgcgggcatctatatgcagtactggttcccggatgttccaacgtggatttgggctgccgccttctttattatcatcaacgccgttaacctggtgaacgtgcgcttatatggcgaaaccgagttctggtttgcgctgattaaagtgctggcgatcatcggtatgatcggctttggcctgtgtctgctgttttctgggcacggcggtgagaaagccagtatcgataacctctggcgctacggcggtttctttgccaccggctggaatggattgattttgtcgctggcggtaattatgttctccttcggcggtctggagctgattgggattactgcggctgaagcgcgcgatccggaaaaaagcatccctaaagcagtgaatcaggtggtgtatcgcatcctgctgttttatatcggttcactggtggttttactggcgctctacccgtgggtggaagtgaaatccaatagtagcccgtttgtgatgattttccataatctcgacagcaacgtggtggcttctgcgctgaacttcgtcattctggtggcatcgctgtcggtgtataacagcggggtttactctaacagccgcatgctgtttggcctttctgtgcagggtaatgcgccaaagtttttgactcgcgtcagccgtcgcggcgtgccgattaactcgctgatgctttccggagcgatcacttcgctggtggtgttaatcaactatctgctgccgcaaaaagcgtttggtctgctgatggcgctggtggtagcaacgctgctgttgaactggattatgatctgcctggcgcatctgcgttttcgcgcggcgatgcgacgtcaggggcgtgaaacacaatttaaggcgctgctctatccgttcggcaactatctttgcatcgccttcctcggcatgattttgctgctgatgtgcacgatggatgatatgcgcttgtcagcgattctgctgccggtgtggattgtattcctgtttgtggcgtttaaaacattgcgtaggaaagtgaactaagctgatgtgaggctgatttgcccgatgcgcaagcttatcgggcctacaatttgtaacgattctgtaggtcggataaggcgttcacgccgcatccgacaaaacgatgtcaaccatccgaaaccgctctcatccattcgatgagagcggtttttttaattactgcttaaatgcacccgccagagagcgaatatcattgccggttggcgactgatgaagtcgcagaccaaactcttcgacaatcgcaaatatgtgatcgaatatatcagcctgaatgctttcatattccagccacaccacggtgttggtaaacgcatagatctcaagcggtaaaccgttatcaccaggagccagttggcgtatcattaaggtcatatctttgcgaatccgcggatgattccgcagatattcgttcagataggcacgaaaggttccaatattggtcattcggcgcaggtttaataccgactccgtagaaccttgctggcgattccactcattaatttcctgatggcggctggttaaataaggctttaacaaatgcgctttattcagacgttgcatttcgtcttcatcaagaaaacgaatactggtgacatcaatactgatactgcgcttaatacgtcgcccgccagatgctgacatcccgctccagtttttaaaggagtcagaaaccagagaccaggtgggaatagtggtaatggtattgtcccagttacgcactttgacggtggttaacccaatatcgatcaccgcgccatccgcgccgtatttcggcatctccagccagtcacccagtttcagcatatcgttcgcggaaagctgaatacctgccaccagaccaagaatcggatctttaaataccaacattagcacggcagccattgcaccaagaccgctgatcagaatcgctggcgactgaccaatcagcagcgagatcatcaaaatgccgaccagaatcgcgccgatcagtttaatcccctgaaaaatccctttcagcggtaactgagatgccgccgggaatttctgcgccagattcaaaatcacatccagcaacgagaagactgaaagcagcgcatacatcatgatccacaactgcgcgcaggtagtcagaatatctgccgcttcggtgcctttttgtagccagaataccgcctgaatattgacgataatcccctgcagggtaaaagctaaacgatggaagagtttattctgggtaatgatttgcaaccatagccgtgaactggcgatggcgcgtttttcaaaggtccgcagtaccacccagtgcaaaaaaatatgcaccacgacggcggtcagaaaaataataccgaaaatcatcaccatcgaggtggtgtgatcaatctcaatacccgctaaatcttcaacctgggatattaaatcctgcataacgtctcctttatacaacagcagcctatgatgacggctgaaacagggttatgcaaatcaggagaatctgaggggaaatagccgggcagatgcccggcaagagagaattacacttcggttaaggtgatgttttgcggcagacgagatttcggcagcgtagcgttaaaatcttcaacgctgtgatgacccaccggaacaaccaccagactggtgtagcctttctctttcagaccaaattcttcatcgaggatggcggcgtcaaaaccttcgatgggtaccgcgtccagacccagcgccgccacgccgagcaggaagttgccgacgttgagataaacctgttttgccatccactctgcatcatcatgcagatctttacggtgcatatcggcgaagaacttgcgacctttatcgttcgcggctttcgcttccggcgtggcaaagcggccatcggcatcttcctggtcaacaaccagctttagccaggcatcgtccatcgcggtttttgcacagaacaccacgacgtgcgaggcatcaagcattttacgctcgttgaacacgtaattatcggcagcggatttggcaacacgcgctttaccttcttccgtgctggcaacaataaaatgccacggctgggagttggtgctggatgggctgtattgcagtagagttttgatctgctcggcctgttccggggtaagttttttgctggcatcaaatgccttagtggaatgacgctttaaggcgacagaaatgatatccataaagactccatgtgaaagtaattttgcgtgccagcagattacaaggatcgagatgaaatggtaagcgagaaaaatgcgctattgatttacggttgagtcaggacgcagtcgtttttgatcgcgcttcgccagaccatcgatcactaaattccatgaatcgttgatcagatcgtgaagtaacgcttcggagatttcatcgccgggatacaccgaaatccagtgttttttgttcatgtgatacccaggcttaatgctcggatatatttgctgatttaacagagatttttgtggatcggacttcagattgataaaggggacgccgcacagctccgacgacagcataaaaatcttgccgccaattttaaaaacatcgaactccgggccaaaaggccagcaaagctcgacaaagggtaactcaagagccaggcgtttcgccgtttcgtgcagtgattgcttatccataaatgttcctttaggcgaaggagaataagcaaagtatgccgcgaagttcggcgataatcgacgtttaatccgccagcgagaaccagcgtcgccagataaagcgtagaacaaaatactcaatagcgcccagcactaaaaaccacagacaaaacaatacagtgtaaagctggctaagatccatcagatggaacgtggtcaccagtttttgtgccagcgtcagccccagtgcgggggcgggcagcagcaggcaagagaggaaagccatcagcaaaatgcctgctgcggtggtcaaggtttctaaagggtgtttcataacattgttaaatgtaagttaaaacaccattgtcagggatattcttctgtaaggcaattcccgacttattctccggcccagatctcacaatgctttttcaccagcccaattagcgagccaccatcggcgacgaaatcacgcattagctgcgcttcattcagaccactgacgacctgacggtgcagtgcttcaattgcgctcgatgcgccaattttatgtgcagaaggggcgattttttccagtaaacgcaaggtggcttccgttagtgaccgacgatcgccagtatgcggatcggtaatgacaccttccagcccatagcgacaggcctggaaacggttgaatttatacatcaggtaatctttctcctgatgtttaaacgggcgttccgtcagtaaccagtgtgcggtggcctgaattaatcccgccatatttaccgcgtggctaagggttaacggggtatccatcacccgaacttccaccgtaccaaaatgggggctggggcgaatatcccagtgcagatctttaatgctgtcgatcatcgtggtgtaactcaggcagcgaaacagggcttcaaattgttgccagttactgacccacggcattgggccattatcgggaaaggcggaaaaaatattcggtcgtgaggaggcaaaacgcgtatccgttccctgcatatatggcgacgcggcggaaagggcgataaagtgcggcacaaaccgtgacaagccgtgcagcaaataaatggcgtcatcgccactggcgcagccaacatggacatgctgaccaaaaacggtcgcctgctggatgagatagccaaagttttccagcgttcgttgatagcgttcgttatcgcatacctcctgacgctgccatttctgaaacggatgcgtgccaccgccgcaaatttccagatgatggtctgccgctgcctgcaatacgactttctgcatcgctgaaaattgcccggcagcctggttgatatcacggcaaacatccgtcgccagctccagcatactttcggttatatcgtgctttacctctccggccgtgatctgatttttaaccgtgtcaatcagcattgatgagtcctggcttaagtcatagcccggcggattaaccacctgcatttccagttcaataccgagggtaaaaggttcagaaacatgaaaatcgggtaatggcataggtttctcttatattggcgttttctattcagtatagaagtgggagcggccgggtgagatgcggaagttctggaatgtttcttttttttggcgatggtgaactgatggtgactgaagcaatttggctacttttgcaatgtgacaagttatggcagagctggctggtggcgaagaattttgacgattgaggcatgcagaaaaaaacgggttcagcttcagttgatcaaatgaggagtgagaagtccgaaacaggacttactgtataaataaacagctattttgctgaagaagggtaagataacggcgggtgcctgaagctttccggtttcaggtttactctgaggtctggaaggatgaagccccaggacgatatttctatcaaccctggggctacctacccaaacctgaacaatttggatggtagtcccttcttcgcatggaggcaatataaacatgctgacgaaatatgcccttgtggcagtcatagtgctgtgtttaacggtgctgggatttacgcttctggtcggagactcgctgtgtgagtttaccgtaaaggaacgtaatattgagtttaaggctgttctcgcttacgaaccgaagaagtagccgttgtgcggggagcaatccccgcatatccggttgtcaggtcagggtggtaaggcacctgctttacactttcgcccgcggtcagtgatggctgcgggcgaatcgtaccagatgttgtcaattaatcgtgttggcacagcgttatgactattttttcttttatctgccagtgcacagcaaacatctcattctcacgatgaattatgacctgttgtttattccggctaattatctgatagtccagaaaatctgcatcagtttggatttcacttgccttaaatgcgctctctttggcggaaaatgccagtgtcagcgccagaggaaaggctaaaccgcagtctgcaagtcgcttgtgttccgctggtgtaataatgttgtctgtcaattctcttgcggtttgtgcagagaaaatctcttcaatatcaatgccaatcggttgacgggaaaccacggctaatgccgtagtcccacagtgactaatactgccgtatacctccgcaggccacacaggttggcgtagctcgccgattgcgggcacacatttatagccatattcccgcagcgcataaactgcagcgatccgcccggctaaatgctctgttttacgtttacgtccagcgtgttgaagttgtgcgtagtgcggcagccagagtaaatcctgctcgcgaaaactcgccggatcaaactcaacaaaatgcagcgtatgtcctgcaaaggggagggaggtatgcgtagttttcatgtcaaccatattagagaatgatgacaaacgcaaaactacctgatgcgctacgcttatcaggcctacgtggtcctgcaatatattgaattggcaagatttttgtaggccggataaggcgttcacgccgcatccggcatgaactacgcgcactttgtcaacaatctgacgttagcttcagaagtgagtattaatgctcatataccacgtacgtcccggctcgttataggtatacgccccggcacctgcgatatagttggctcctgccagatcgcccgtggtctgggcattacccgcacgccacaaacgtttgtcgaacaggttgtccacgccgccggtcagactgacattcttggtcacatcctaggtcgcgctcaggccaacaatgctgtacggactgatttctttggtttccggtccaaccgctgactgacctttatagttgtacttcttcggctgctgtttgccgtaccaggtgaaggtcgtttgcatcgacaaatcttcccgtgcctgccagctcagcgttgagttcaacgtatactccgggatgatcgacaaacggtcgcccgtggttttgttttcactcttcagcatataagtgatgttattggtccacatcaccgtttcgctaaccggtacgtttaacgatccttccagaccttcaaccaccgctttcggcacgttatcccactgatagagatcggtgccgactgcgttttgccctacagctacatagcccgcttcaatcttattgcgataatcgttacggaaccaggtcacgtccgccagccaaccgtcgcgtttgaactccagaccaatctccttgttgatgctggtttctgctttcaggtcatcattaccttgcagatagcagccgcccgcgctggcatagcagccctgacctttactgtagagaatgtagtttgggttagtctggtacaggctcggcgctttataggcgcgggcgatgcccattttcagcgtgaagtcatcgcctaaaccttgcgatatgttcagcgccgggctccagttattgccgacaatactgtgatgatcgaaacgcagccccggcgttacgatggtgctgtcagtcagctccatattgttttcggcaaacagcgagaaaatttctgcttttgaatacgggctacggtcggtggcactcacaccatcaatagcaccgccggtattcgtcccggtcagcgcctgggtgttggaacttaagtccttcatccgttgctgattccactctgtacccagcgtcagcgtttggtttacgaggaaatcaatcggcaggttaacttcgctgtgcagcatcacgtcatcaagatcgatatctacaaaatcctgtgccgctttttcgttaaatttcccttcggtaccgcccgccagaccttccggaatacgcgagttacgggtgtgttcgtactgcacccagttgctggtggtcacgccgttatcccagccaccgttccaggtcagcgagtagttctggcgatacaggcggttggtttcatcgccatatttcgatcgagtgtaagcgtcagagttggtgttctgcgtatcacccgcatacaggttaccctggcggctgtagcccgcttccagttcgagtgactgcagaggcgcgaagtcccagcgcaccacgccattaatatctttgttgatcaccccttcgcgcccggctggtaacgtcgtggcatacgttccggcacgcgcggactgatggccctggttgatatcccacgcgtcagcctgggttttgtcgaggttgccatacaagcggaagctgaattcgtcgcccagcggaccggtcaggctgaagttggtgcgtttggtggcaccttcctctttatgttctggcgcattgaaataagcatcccaggagccgtgccactcaccgctgccttttttggtaatgatgttaaccacgccgcccgccgcgccgttgccataacgcgcagctgccggaccacgcagcacttcaatacgttcaatcatttcaggcggcacccaggaggtatcaccacgggtatcgcgctcgccacgccagccctgacgcacagagttacggctgcttaccggcttgccgtcaatcaaaatcagcgtgttttccggacccatgccgcgaatatcaatctggcggttattaccacgctgaccactggtggagttaccggtcaggttaacgccaggcatggtacgaatgatctccgatacatcgcgggcaaccgggtttttgcggatttcatctgcggtaatggtcgaaacgccaggcgcctgcaagttctgctcggcggcggtaacgacaatggtatcgtcatgtgaaacaggagtatcggtcggctcttgtgcctgtgctaccccataaatccccagattgaccaacaaggccagggaatgaatcttcttgttcattgttttattcctgcatttttgccacgaattgcaactgtcgggcatggtcgccatcaacacgacgcatcccgctaccgcgaaaacctttgatcctgaaagacacgcagtgcagctgattaattaatgtccgcgcttcccacggcgcgccattacgctattgcaaatgcaaatagttatcaataatattatcaatatatttctgcaatcaataaaaaattgcacagtaaacatggggttatggtgtgacggcgttaaaagtaggaagtgagagctggtggcagtcgaaacatggcccggaatggcaacgtctgaatgacgaaatgtttgaggtcactttctggtggcgtgatccccagggttctgaagaatactcgacgataaagcgcgtatgggtctatatcactggcgtgaccgatcaccatcagaacagccagccccggtcgatgcagcgaattgcaggaaccgatgtttggcagtggacgacacaactcaatgccaactggcgcggcagctactgctttattcctactgaacgcgatgacattttttctgcaccatcccccgatcgcctcgaattacgcgaaggctggcgaaaactattaccccaggcgatagccgatccgctgaatccacaaagctggaaaggcgggcgagggcacgctgtttctgcactcgaaatgccgcaagcgcctctgcaaccgggatgggattgtccgcaagcgccagaaacgcctgccaaagaaattatctggaaaagtgaacggttgaaaaattcacgccgtgtatggatttttaccaccggcgatgcaacagcagaagaacgcccgctggcagttttgcttgatggcgaattttgggcgcagagtatgcccgtctggcctgcgctgacttcgctgacccatcgtcggcaacttccgcccgccgtgtatgtgttgatcgacgctatcgacaccacgcaccgcgcccacgaactgccgtgtaatgcggatttctggctggcagtacagcaagagttattaccccaggtgaaagctattgccccttttagcgatcgcgccgatcgcaccgtggtcgccggacagagttttggtgggctttccgcgctgtatgccggactgcactggcctgaacgctttggctgtgtattaagccagtcaggttcgtactggtggccgcatcggggcgggcaccaagagggcatgttacttgaacagctaaatactggtgaagttagcgccgaaggtctgcgcattgtgctggaagcgggtgttcgcgagccgatgatcatgcaggccaatcaggcgctgtatgcgcaattacaccccctaaaagaatccattttctggcgtcaggttgacggcggacatgatgcgctttgttggcgcggtggcttgatgcaggggctaatcgacctctggcaaccacttttccatgacaggagttgaatatggcattcagtaatcccttcgatgatccacagggagcgttttacattttgcgcaatgcgcaggggcaattcagtctgtggccgcaacaatgcgccttaccggcaggctgggacgttgtgtgtcagccgcagtcacaggcgtcctgccagcagtggctggaagcccactggcgtactctgacaccggcgaatttcacccagttgcaggaggcacaatgagccagcatttacctttggtcgccgcacagcccggcatctggatggcagaaaaactgtcggatttaccctccgcctggagcgtggcgcattacgttgagttaaccggagaggttgatgcgccactactggcccgcgcggtggttgccggactagcgcaagcagatacgttgcggatgcgttttacggaagataacggcgaagtctggcagtgggtcgatgatgcgcagacgttcgaactgccagaaattatcgacctgcgaaccaacattgatccgcacggtactgcgcgggcattaatgcaggcggatttgcaacaagatctgcgcgtcgatagtggtaaaccactggtctttcatcaactgatacaggtggcggataaccgctggtactggtatcagcgttatcaccatttgctggtcgatggcttcagtttcccggccattacacgccagatcgccaacatttactgcgcattgctgcgtggcgaaccaacgcctgcttcgccgtttacgcctttcgctgatgtagtggaagagtatcagcagtaccgcgaaagtgaagcctggcagcgtgatgcggcattctgggcggaacagcgtcgtcaactaccaccgcccgcgtcactttctccggcacctttaccggggcgcagcgcttcggcagatattttgcgcctgaaactggaatttaccaacggggaattccgccagctggctacgcaactttcaggtgtgcagcgtaccgatttagcacttgcgttggcagccttgtggctggggcgattgtgcaaccgcatggactacgctgccggatttatctttatgcgtcgactgggctcggcggcgctgacggctaccggacccgtgctcaacgttttgccattgggtattcacattgcggcgcaagaaacgctgccgcaactggcaacccgactggcagctcaactgaaaaaaatgcgtcgccatcaacgttacgatgccgaacaaattgtccgtgacagcgggcgagcggcaggagaggaaccgctgttcggtccggtactcaatatcaaggtatttgattaccaactggatattcctggtgttcaggcgcaaacccatactctagcaaccggtccggttaatgaccttgaactggccctgttcccggatgaacacggtgatttgagtattgaaatcctcgccaataaacagcgttacgatgagccaacgttaattcaacacgctgaacgcctgaaaatgctgattgcgcagttcgctgcgaatccgtcgctgttgtgcggcgatgtcgatattatgctgccaggtgagtatgcgcagctggcgcagatcaacgccactcaggttgagattccagaaaccacgctgagcgcgctggtggcagaacaagcggcaaaaacaccggatgctccggcgctggcagatgcgcgttaccagttcagctatcgggaaatgcgcgagcaggtggtggcgctggcgaatctgctgcgtgagcgcggcgttaaaccgggcgacagcgtggcggtggctctaccgcgctcggtctttttgaccctggcgctacatgcgatagttgaagctggtgcggcctggttaccgttggataccggctatccggacgatcgcctgaaaatgatgctggaagatgcgcgtccgtcgctgttaatcaccaccgacgatcaactgccgcgctttagcgatatccccaatttaaccagcctttgctataacgccccgcttacaccgcagggcagtgcgccgctgcagctttcacaaccgcaccacacggcttatatcatcttcacctcaggttccaccggcagaccaaaaggggtaatggtcggtcagcaggctatcgttaaccgcctgctatggatgcaaaaccattacccgcttacaggcgaagatgttgttgcccaaaaaacgccgtgcagttttgatgtctcggtgtgggagtttttctggccgtttattgccggggcgaaactggtgatggctgaaccggaagcgcaccgcgacccgctcgctatgcagcatttttttgctgattatggcgtaacgaccacgcactttgtgccgtcgatgctggcggcatttgttgcatcgctgacgccgcaaaccgctcgccagagttgcgcgacgttgaaacaggttttctgtagtggtgaagccttaccggctgatttatgccgcgaatggcaacagttaaccggcgcgccgttgcataatctatatggcccgacggaagcggcggtagatgtcagttggtatccggcttttggcgaggaactggcagaggtgcgcggcagcagtgtgccgatcggttatccggtgtggaatacgggcctgcgcattctcgatgcgatgatgcatccggtgccgccgggtgtggcgggagatctctatctcaccggtattcaactggcgcaggggtatcttggacgacccgatctgaccgccagccgctttattgccgatccttttgccccaggtgaacggatgtaccgtaccggcgatgtggcccgctggctggataacggcgcggtggagtacctcgggcgcagtgacgatcagctaaaaattcgcgggcagcgtatcgaactgggcgaaattgatcgcgtgatgcaggcgctgccggatgtcgaacaagccgttacccacgcctgtgtgattaaccaggcggcagccactggtggtgatgcgcgtcagttggtgggctatctggtgtcgcaatcaggtctgccgttggataccagcgcattacaggcgcagcttcgagaaacattgccaccacatatggtaccggtggttctgctgcaacttccacagttaccacttagcgccaacggcaagctggatcgcaaagccttaccgttgcctgaactgaaggcacaaacgccggggcgtgtgccgaaagcgggcagtgaaacgattatcgccgcggcattctcgtcgttgctgggttgtgacgtgcaggatgccgatgctgatttctttgcgcttggcggtcattcgctactggcaatgaaactggcagcgcagttaagtcgacagtttgctcgtcaggtgacgccggggcaggtgatggtcgcgtcaactgttgccaaactggcaacgattattgatggtgaagaagacagcacccagcgcatgggattcgaaaccattctgccgttgcgtgaaggtaatggcccgacgctgttttgtttccatccggcatccggttttgcctggcagttcagcgtgctctcgcgttatctcgatccacaatggtcgattatcggcattcagtcgccgcgccctcatggccccatgcagacggcggcaaacctggatgaagtctgcgaagcgcatctggcaaccttacttgaacaacaaccgcacggcccatattacctgctgggttattcacttggcggtacgctggcgcagggcattgcggcgcgactgcgtgcccgtggcgaacaggtggcatttcttggcttgctggatacctggccgccagaaacgcaaaactggcaggaaaaagaagccaatggtctggatccggaagtgctggcggagattaaccgcgagcgcgaagccttcctggcggcacagcagggaagtacctcaacggagttgtttaccaccattgaaggcaactacgctgatgctgtgcgcctgctgacgacagctcatagcgtaccgtttgatggtaaagcgacgctatttgttgccgaacgcacgcttcaggaaggtatgactcctgaacaggcctgggcaccgtggattgctgagctggatatctatcgtcaggattgtgcgcatgtggatattatttccccggagtattttaaagaaataggaccactaataaatacacaaattaataactaaccgtacgttagtaaagaacttgccataacctcatgtaaaaccataatccgactaaatgattatggtttttttattcttaaaatttatttatttttctgagagcagcgtcattgctggggttgctaagtttgttattcattttgagaataataatagtgaaagagtgctttcggataaatctcagttcctgttagaatgctatgtacatcgttgtgctttacggactaaaacctcaggtttcactacatgtcatcactgaatattaaacagggaagtgaagctcattttcccgagtatcctctggcgtcgcccagtaataatgaaattgatttacttaatctaatcgaggttttatggcgggcaaaaaaaaacggtcatggcggtcgtttttgcgtttgcctgcgcaggcttgctgatctctttcatcctgccgcaaaaatggactagcgcggcggttgtcacgcctccagaacctgttcagtggcaagagctggagaaaacattcactaagcttcgtgtgctggatctggatatcaaaattgatcgtacagaagcatttaacctgtttatcaagaaatttcagtctgttagcttgcttgaggagtacctgcgttcatcaccttatgtgatggatcaattaaaagaagcgaaaatcgacccactggatctgcatcgcgccattgttgcattgagggaaaaaatgaaagcggttgatgacaatgccagtaagaaaaaagatgagtctgcattgtatacttcctggacgctaagtttcaccgcacccaccagtgaagaggcacagaaagtgttggccgggtatatcgattatatctctgcgttggtggtgaaagagtcgatagaaaacgtccgtaataaactggagatcaaaacccagtttgaaaaagaaaaactggctcaggatcgcattaaaacgaaaaatcaacttgatgcaaacattcagcgcctcaattattcacttgacattgccaacgcggcaggaattaaaaagcccgtatacagtaatggtcaggccgttaaagatgaccccgatttctctatttctctcggtgcagacggtattgaacgcaaactggaaattgaaaaagcagtcactgacgttgcggaattgaacggtgaattacgtaatcgtcagtatctagtcgagcaattaacaaaaacaaatgtcaacgatgtgaattttacaccgtttaaatatcagttgcgtccgtcattacccgtaaaaaaagacggtcagggtaaggcgattatcgtgatcctttctgcgttggtcggcgggatggtggcttgtggtggtgtgttgttgcgtcatgcgatggcatccagaaaacaggatgccatgatggcagaccacttagtttaaatctttgcggttgaaggtgccgttcgtccgagcggcaccacgagcggcgttccggcaaccggatcgtcaataatcatgcagcgcagaccataaatgcgctcgatcagttcagcagtgacaatctccttcggtgctccctgagcaacaattttcccttcccgcaatgcaatcaaatggctggcgtaacgacaggcctgattaagatcgtgcagcaccgccgccagggtatagcctttctcgcggttcagttcgcttaacagttccagcaaatcaatctgatgactgatatccagccaggtcgtgggttcatcgagcagcataattgccgtttcctgggccagcaccatcgcgatccacgctcgctggcgttgtccgccagaaagggtgtccacgctttgatccgccagatgagttattcccgtggcctgcatcgcttttgttaccgcgtcttcatcttctttgcgccagcgggtaaacagcggttgatgcgggtaacgcccacgcgccaccagttcctgcacggtgatatcgcccggtgtggtagcattttgcgccaacagaccaatccggcgtgcaacctctttactggcgtaatgttgaatgtgctcgccatccagccagacatgcccgtgagcaggcgtcatcaggcggcttaaggtacgcagtaacgtggatttaccgcagccatttggcccgataattgccgtgaagtgaccatcaggtatttctacagtcagattttccgcaacggtatatttgccatatccgagggttaactgttcgccgcgcaaacgggctactgattcggtcattttttgcgagactcctgaattaacaagacgataaggtaaataccgccgaggctgacggtaacgacgccaaccggaagttgatacggcataaacagttgttgggcgcagagatcggccaccagcagtaacaacgccccgcacagcgccgcctgggtcagcccccagcgagcggtgccactgatgcggcgggcaatgtgtggcgcgactaaagcaataaaggaaattggccccgccagggcagtggcagctgcggtaagcactacggcgaccagcatcattaacagtcgcgaacgttcgacgctgacgcccagcgcacatgcggtatcatcgcccatttccagcaagcgcattcgccgcaccagcaaggcggcggcaattaacattaatataatgatgggtgcggaaggcgaggtttttgcccacgtcaggccattgagcgatccggcattccacaaacccgctgttagcgccgtttctaaagacgctttcagcaacagccaggtattaaaggccaccagcatggcgcgaacaccgataccgataataatcaaccgaaaggtgtcgataccgttacgccaggcgagcagccagaccaacagcgaagtgacaatgccgcccaccattgctgccagcgcgatagccgtcaggtcctgaccaaacagcaccatcgccaccagcacgccgctccacgccccggtgttaaagcccattacgtcagggctgccgagcgggttacgcatcagcgactgaaaaatcgcgccgctgacgcccagcgccgcgccaatcaacagcgccatcagcacgcgtggtaaacgccattcggtgaccaccatcgtcatactgcgcggcgtgtcgcccatcaacgcggcgaatacctgcgaagtttccagcgtgacggcaccgctacgtaatccccacacgcctgccatcacacaagctattagcaacagcagacaggtgataattaatcggcgagagacgtaaatcatgcgccacctcgcgttttacgtcgtacgaggaagatcagcactggtgcgccaataaaggcactgactacagaaacgcgcagttcgccgggaacaatcacccgcccaatgatatcggcaaacagcagcagggcaggggtagcgagtagcgtgacgggcagcgaccagcgatgatcggcacctaccagccagcgcgccatgtgcggcatcatcaggccaataaaggcaatcgggccaactaccgccgtcgcactaccacaaagcacggtaattgccagcagaccaatcaactgtgtgcgcgctacgcgactgcccagtgccgtcgcggtgtcactgccaaggcttaaactgttcagcgcgcggctcagtaatagcgcagttgctccagcggtaagcaccgggattagcaccacttttaaggtatgtagattgcgaatatccagcgaaccggcttgccagaaacgcagttgatcgtagacgtcgggattaagcagggcgatgccgctggtcagcccttccagcaccgccgccagcgccacgcccgctagggttaaacgcaccggacttaactgcccgccgccctggctgccggtaaaggcaacaatcaacgaggccaccagcgccccggcgaaggccatcgccagttgctcctgcgcggaagagtaaccaaacagcgccgcgcccagcacaatggcaaaactggcaccggcgttcacgccaagcaaaccaggatcggcaagcgggtttcgggtgagggtttgcattaacgccccggcaaggccaagcgcaccgcctgccagtaaaccggcaagggtgcgcggcagacgggcgtcgagcacaatggtgctggaggcgctctggcaggtgccggagagcgcctccagcactacggaggcggggagtgattttgccccaatgagtaggcttaatgccgtcgcgataatcagtaataacagcaatccgggcacggcaatggcgcgtgtcacggcaacagaaccagacatacgaacttccatgataatgaaattaattatcgttatcgatcttatttggatatgttagcatgtgcagcctaagaataggtatttaaaatatttgatggcaaggcattgtaatgaataaacaatcctggctgcttaacctcagcctgttgaaaacgcacccggcgtttcgcgcagtattcctcgctcgttttatctcaattgtttctctgggtttgctcggcgtcgcggtgccggtgcagatccagatgatgacgcattctacctggcaggtggggctttcggtgacgctgaccggcggcgcgatgtttgttggcctgatggtcggcggtgtgctggcggatcgctatgagcgcaaaaaagtgattttgctggcgcgcggcacctgtggcattggcttcattggactgtgcctgaacgcgctgctgccggagccatctctattggcaatctatttacttggtttatgggatggttttttcgcatcacttggcgttacggcgctactggcggcgacacctgcactggtagggcgtgaaaacttaatgcaggccggggcgatcaccatgttgactgtgcgcctgggatcggtgatttcgcccatgattggcggtttactgctggcgactggcggtgtggcctggaactacgggctggcggcggcgggcacgtttattaccttgctaccgttgttaagccttccggcgttaccaccaccaccgcagccgcgtgagcatccgttgaaatcattactggcaggatttcgttttctgctcgccagcccgctggtaggagggattgcgctgttgggtggtttattgacgatggcgagcgcggtgcgggtactgtatccggcgctggctgacaactggcagatgtcggcggcacagattggttttctctatgcggcgatcccgctcggcgcggctattggcgcgttaaccagcgggaagctggcacatagcgcgcgaccagggttattgatgctgctctccacgctgggatcgttcctcgccattgggctgtttggcctgatgccgatgtggattttaggcgtgatttgtctggcgctattcggctggctgagcgcggtcagctcgttgctgcaatacacaatgctgcaaacgcaaaccccggaagcgatgttagggcggattaacggtttgtggacggcgcaaaacgtgacgggcgatgctataggcgcggcgctgttaggcggtctgggagcgatgatgacaccggttgcttccgcaagcgcgagcggttttggtttgttgattatcggcgtgttgttattgctggtgctggtggagttgcggcgttttcgccagacgccgccgcaggtgacagcgtccgacagttaatgcttaaaacagcgccttaagccgttccagcacttgcatggcgctgtagtaatccagacggaacgtctcggttcccagcgcataaacctgcttgttttgtactgcaggcaggtgcgcgagcagcggattagcataaatcgcatcggcatctttctgatcaccggcgaacaggaatagtgactcgccatttaaccctgcagccagattttccccaccaagctgaatgatgtcatggcgtttgccctggctttggctggcgtttaaccctgcgggcaacttcgccagcgtaaagccgagttgttccagcatctgcccttgtgctgattccggcgtccagagattggcactgtgtgcagcggcggtatagacaatggcagtgaccggctgcggaggtaatttgatttgctctttcgccgccgccagttgcttatcaaactgcgcaatccgctctgccgcttgtttctcatgcccggtaatttcgccaagctgcgttaacagcgactgccagcttttgtcgtcgtaattgatgattaatgttggggcgatggtggaaagctgatcgtacagcgccagcgctgaatcaccgccggttgcgctaattaaaatcagatccggcatttgcgcggcaacggcttctgcactcggttcgccgatatagagccgttgcagtttgcgttctttcgccaccttgctccactggcgtaaaaagccctggtcatccgcgacgcggttatttggcgtggtcgcgccgctggcgatcaccggagcatcaatcgccagcagtgagccggtcagggtgacgctggtggaaacaatacgctgcggctggctttccagggtatgagtgccccggctgtcagtaatctgacgcggccagtcggcagcctgaactgcggctattcctgaaagcaaaagtcctgttaatagaagggcgttgcggtagagcggggcgagtctcacaagtcagcttcctgttattaatgaagttaatgcttctcattttcattgtaaccacaaccagatgcaaccccgagttgcagattgcgttacctcaagagttgacatagtgcgcgtttgcttttaggttagcgaccgaaaatataaatgataatcattattaaagcctttatcattttgtggaggatgatatggatacgtcactggctgaggaagtacagcagaccatggcaacacttgcgcccaatcgctttttctttatgtcgccgtaccgcagttttacgacgtcaggatgtttcgcccgcttcgatgaaccggctgtgaacggggattcgcccgacagtcccttccagcaaaaactcgccgcgctgtttgccgatgccaaagcgcagggcatcaaaaatccggtgatggtcggggcgattcccttcgatccacgtcagccttcatcgctgtatattcctgaatcctggcagtcgttctcccgtcaggaaaaacaagcttccgcacgccgtttcacccgcagccagtcgctgaatgtggtggaacgccaggcaattccggaacaaaccatgtttgaacagatggttgcccgcgccgccgcacttaccgccacgccgcaggtcgacaaagtggtgttgtcacggttgattgatatcaccactgacgccgccattgatagtggcgtattgctggaacggttgattgcgcaaaacccggttagttacaacttccatgtcccgctggctgatggcggcgtcctgctgggggccagcccggaactgctgctacgtaaagacggcgagcgttttagctccattccgttagccggttccgcgcgtcgtcagccggatgaagtgctcgatcgcgaagcgggtaatcgtctgttggcgtcagaaaaagatcgccatgaacatgaactggtgactcaggcgatgaaagaggtactgcgagaacgcagcagtgagttaaacgttccttcctctccacaattgattaccacgccgacgctgtggcatctcgcaactccctttgaaggtaaagcgaattcgcaagaaaacgcactgactctggcctgtctgctgcatccgacccccgcgctgagcggtttcccgcatcaggccgcgactcaggttattgctgaactggagccgttcgaccgcgaactgtttggcggcattgtgggttggtgtgacagcgaaggtaacggtgaatgggtggtgaccatccgctgcgcgaagctgcgggaaaatcaggtgcgtctgtttgccggagcggggattgtgcctgcgtcctcaccgttgggtgagtggcgcgaaacgggcgtcaaactttctaccatgttgaacgtttttggattgcattaaggagcgaggatgagcattccattcacccgctggccggaagagtttgcccgtcgctatcgggaaaaaggctactggcaggatttgccactgaccgacattctgactcgccacgctgcgagtgacagcatcgcggttatcgacggcgagcggcagttgagttatcgggagctgaatcaggcggcggataacctcgcctgtagtttgcgccgtcagggcattaaacctggtgaaaccgcgctggtacaactgggtaacgtcgctgaactttacattacctttttcgcgctgctgaaactgggcgttgcgccggtgctggcgctgttcagccatcagcgtagtgaactgaacgcctatgccagccagattgaaccggcgttactgattgccgatcgccaacatgcgctatttagcggggatgatttcctcaacacatttgttgcagagcattcttccattcgcgtggtgcagctgctcaacgacagcggtgagcataacttgcaggatgcgattaaccatccggctgaggattttactgccacgccatctcctgctgatgaagtggcctatttccagctttccggcggcaccaccggcactccgaaactgatcccgcgcactcataacgactactactacagcgtgcgtcgtagcgtcgagatttgtcagttcacacaacagacgcgctacctgtgcgcgatcccggcggctcataactacgccatgagttcaccgggatcgttgggggtatttctcgctggcggcactgtcgttctggctgccgaccccagcgccacgctttgcttcccattgattgaaaaacatcaggtgaacgtcaccgcgctggtgccgccagcagtcagcctgtggttgcaggcactggctgaaggcgaaagccgggcgcagcttgcctcgctgaaactgttacaggtcggcggcgcccgtctttctgccacgcttgcggcgcgtattcccgctgagattggctgccagttgcagcaggtgtttggcatggcggaagggctggtgaactacacccgtcttgatgatagtgcggagaaaattatccatacccagggttacccaatgtgcccggacgatgaagtatgggttgccgatgccgaaggaaatccactgccgcaaggggaagttggacgcctgatgacgcgcgggccgtacaccttccgtggctattacaaaagcccgcagcacaatgccagcgcctttgatgccaacggtttttactgttccggcgatctgatctctattgatccagagggttacatcactgtgcaggggcgcgagaaagatcagatcaaccgtggcggcgagaagatcgctgccgaagagatcgaaaacctgctgctgcgccatccggcggtgatctacgccgcactggtgagcatggaagatgagctgatgggcgaaaaaagctgtgcttatctggtggtaaaagagccgctgcgcgcggtgcaggtgcgtcgtttcctgcgtgaacagggtattgccgaatataaattaccggatcgcgtggagtgtgtggattcacttccgctgacggcggtcgggaaagtcgataaaaaacaattacgtcagtggctggcgtcacgcacatcagcctgaaggagagaacacgatggctattccaaaattacaggcttacgcactgccggagtctcacgatattccgcacaataaagtcgactgggcctttgaaccgcaacgtgccgcgttgttaatccatgatatgcaggactattttgtcagcttctggggtgagaactgcccgatgatggagcaggtgattgcgaatattgctgcgctacgcgactactgcaaacagcacaatatcccggtttattacaccgcccagccgaaagagcagagcgatgaagatcgggcgctgttgaatgatatgtgggggccaggcctgacccgttcgccggaacagcaaaaggtggtggatcgcctgacgccagatgccgacgacacggtgctggtgaagtggcgctacagcgcgtttcatcgttccccgctggagcaaatgctcaaagagagtggacgtaaccagctgattattaccggggtatatgcccacattggctgtatgaccaccgcaacggacgcatttatgcgcgatattaaaccgtttatggtggcggatgcgctggccgatttcagccgtgacgagcatttgatgtcgctgaaatatgtggccggacgttctggtcgggtggtgatgactgaagaattactgccagcacctgtccccgccagcaaagcggcgctgcgtgaggtgatcctgccgttgctggacgagtccgatgaaccgttcgatgacgacaacctgatcgactacggtctggattcggtgcgcatgatggcgctggcggcgcgctggcgcaaagtgcatggcgatatcgactttgtcatgctggcgaaaaacccgaccatcgacgcctggtggaagctactctcccgcgaggtgaaataatggatttcagcggtaaaaatgtctgggtaactggcgcggggaaaggtatcggctatgccacggcgctggcatttgttgaggcgggggcgaaagttacaggttttgatcaagcgtttactcaggagcaatatccttttgcgaccgaagtaatggatgttgccgatgctgcgcaggtggcgcaggtatgtcagcgactgttagctgaaacggagcgactggacgtgctggtcaatgcggcgggaattttgcgcatgggcgcgaccgatcagctcagtaaagaggactggcagcagacttttgcggtcaacgtcggcggtgcgtttaacctgtttcagcagaccatgaaccagtttcgccgtcagcggggcggggcgattgttactgttgcgtccgacgccgcacacacgccgcgcattggtatgagtgcttatggcgcgtcgaaagcggcgctgaaaagcctggcgttgagcgtcgggctggaactggcgggtagcggcgtgcgctgtaatgtggtttcgccgggctccaccgacactgatatgcaacgcacgctgtgggtgagcgatgacgccgaagagcagcgtattcgcggctttggcgagcagtttaaactcggcattccgctagggaaaatcgcccgtccgcaggagattgccaatacgattttgttcctcgcctctgacctcgccagccatattaccctacaggatattgtggtcgatggcggctcaacgctgggggcataagcatgatctggaaacgccatttaacgctcgacgagctgaacgccaccagcgataacacaatggtggcgcatctgggaattgtgtatacccgtctgggcgatgatgtactcgaagccgaaatgccggttgatacccgtactcatcagccgtttggcctgctgcatggcggcgcgtcggcggcgctggcggaaacgctgggatcgatggccggatttatgatgacccgcgacggacagtgtgtggtgggcacggaacttaacgccacacatcatcgcccggtgtctgagggaaaggtgcgcggtgtctgccagccgctgcatcttggacgacaaaatcagagctgggaaatcgtcgttttcgatgaacaggggcggcgttgctgcacctgtcggctgggcacagcggttttgggatgaacccgacagaataaaatgagattgcaggaaaattcggttaacggagtgatcgagttaacattgttaagttaaatattggtttcaactccgatttacatggttgctgtgttgttaaattgtacaaagatgttatagaaacaaaatgtaacatctctatggacacgcacacggataacaactatgaacaaatcagggaaatacctcgtctggacagtgctctctgtaatgggagcatttgctctgggatacattgctttaaatcgtggggaacagatcaacgcgctgtggattgtggtggcgtcggtctgtatctatctgatcgcttaccgtttttatgggctgtatatcgccaaaaatgtgctggcggttgacccgacgcgtatgacgccagcggtgcgccataacgacgggctggactatgtgccgacggacaaaaaagtgctgttcggtcaccattttgcggccattgccggagcaggtccgttggttgggccggtactggcggcgcaaatgggttacctgccagggatgatctggctgctcgccggggtggttctcgccggtgcggtgcaggatttcatggtgctgtttgtttctacgcgccgtgacggtcgctcgctgggtgagctggtcaaagaagagatggggccaaccgccggggtgatagcgctggtggcctgctttatgatcatggtcattatccttgccgtgctggcgatgatcgtggtgaaagccctgactcatagcccgtggggaacgtataccgttgcgttcaccattccgctggcgctgtttatggggatctacctgcgctatttgcgtccggggcgtattggcgaagtgtcggtgattggcctggtattcctgattttcgccattatctctggcggctgggtggcagaaagcccgacctgggcaccgtactttgactttaccggcgtgcagctgacctggatgctggtgggttacggcttcgtggcggcggtgctgccggtgtggttgctgctggccccgcgtgactacctctcaaccttcctgaaaatcgggactatcgtcggtctggcggtaggcattctgattatgcgcccgacgctgaccatgcctgctctgaccaaatttgttgatggcactggcccggtatggaccggtaacctgttcccgttcctgtttatcaccatcgcctgtggcgcggtgtctggcttccatgcgctgatctacaccgaagatgctggcgaacgaagggcaggcgtgctttatcggctacggtgggatgttgatggaatccttcgtggcgattatggcgctggtttctgcctgtatcatcgatccaggtgtgtacttcgctatgaacagcccgatggcagtgctggctccggcagggacggcggatgtagtcgcttctgcggcgcaggtggtgagtagctggggctttgcgattaccccggatacgctaaatcagattgccagcgaagtgggggaacagtcgatcatttcccgtgcgggcggtgcgccgaccctggcggtggggatggcctacattctgcacggtgctctgggcggcatgatggatgtggcgttctggtatcacttcgccattctgtttgaagcactgtttattctgacggcggtggatgcaggtacgcgtgctgcgcgctttatgttgcaggatctgctgggcgtggtgtctctgggcctgaaacggaccgattcactgcctgctaacctgctggcaacggcgctgtgcgtactggcgtggggctacttcctccatcagggtgtggtcgatccgctgggcggtattaacaccttgtggccgctgtttggtattgccaaccagatgctggcagggatggcgctgatgctctgtgctgtggtgctgttcaaaatgaaacgtcaacgttacgcctgggtggcgctggtaccaacggcctggctgctgatttgtaccctgaccgcaggctggcagaaagcgtttagcccggatgcgaaagtcggcttcctggcgattgctaacaagttccaggcaatgatcgacagcggcaatattccgtcgcagtatactgagtcacaactggcgcaactggtgttcaacaaccgtctggatgccggattaaccatcttctttatggtggttgtggtggttctggcgctgttctcgattaagacggcactggtggcattgaaagagccgaagccaacggcgaaagaaacgccatatgagccgatgccggaaaatgtcgaggagatcgtggcgcaggcgaaaggcgcgcactaaagtcagagtgagggggaatgtgctgagcgttccccttactctcatcccgagcgtgttgatagcaattaagccctcttaattcaggagggcatttgtattaccggaggtttagatgtttgattcactggcaaaagccggaaaatatttaggtcaggcggcgaaactgatgattggtatgcctgattacgacaactatgtcgaacatatgcgggttaaccatcccgatcaaacaccgatgacctacgaggagtttttccgggagcggcaggacgcgcgctacggtggaaaaggcggcgcgcgctgctgctaaatttgtacgtcaggctttaaacgattccactttttcgaacgctgcacgcaacgtatctggtgtcagcgtgactggcaggtaatgaatggattccaccggacgtagggtgtgggcaatcattttgtcgatctccacctgattattgatatccacttccagctccgccagcgtagtcggcagatgaaaacgctgatacgcctctgttaattgcgccagcacatcatcctgacccagcaaggcgctttgcaccagaattccgtaagcgactttggtgccgtggagaaacttctcggtttgtggcaaaacggtcagaccgttatgcacggcatgggccgccgccacacgcgtaaaacgatcgcccagaccaccgaccattccaccaccagcaataatggcatccaccacatcgcaaaatgattgcgttaattgctgattttgctgaccggcaagcgcctgttcgctactgtttaacaagacgtcgcgaatggcctgcgcattattgattcccagccgcacggttagcggcaacgtttctggttgcggagccagcaccaccgcttcataccatttcgccagcgtgtcaccgatccccgccagtagatattcttgtggcgcattgaggataatctccggttccaccagcaccataaaattggcgtcgtcgaaaatctcataatgcagcgcttgtccggcatcgttataccagacggagagcggtgtccaggcggcgcaggtagcggcgatcgtcggaacggcaacaaacggcagaccgagacggcgggcgagggctttcgcggtgtcgagtagtgcgccgccgccgacgccaatcaccacgctgcgatcgtcaccggactcagccgccagttgttgtacatcgctttcgctgcaatggccgcgaaacaaaatatgctttgcccctggcagttcaaacgctggcggaagttttgtttgcgccgcagcaatggcgcgttcaccgtagatccacaccgcgcgagaaagttgttcatcagtgaaaaaatcgtgcaggtgattgaaacttcctggatgtgaaaagtagttagccgggccgacgaccacgcggataggattgtgaggcatgttgtgttgtccttattgttttatttagacatctaaacgtcttgattgccaaatactagcatcgtgttatagtgccttcaacacgcaacttcgtcaggtacaataaaaatgacaaataaccctctgattccacaaagcaaacttccacaacttggcaccactattttcacccggatgagcgcgctggcgcagcaacaccaggcgattaacctgtcgcaaggctttcctgattttgatggtccgcgctatttacaggagcggctggcgtaccacgttgcccagggggcaaaccaatacgcacccatgaccggcgtgcaggccttgcgcgaggcgattgctcagaaaacggaacgtctgtatggctatcaaccggatgtcgacagcaatatcaccgtgacggcaggggcgacggaggcgttatacgcggcgataaccgcattggtgcgcaatggcgacgaagtgatttgttttgatcccagctatgacagttacgcccccgccatcgcactttcggggggaatagtgaaacgtattgcactgcaaccgccgcattttcgcgttgactggcaggaattttccgcattgttaagcgagcgcacccgactggtgatcctcaacaccccgcataaccccagtgcaactgtctggcagcagactgatttcgccgctctgtggcaggcgatcgccgggcacgagatttttgtcattagcgatgaagtctacgagcacatcaatttttcacaacagggccatgccagcgtgctggcgcatccgcaattgcgtgagcgagcggtggcggtgtcatcgtttggcaagacctatcatatgaccggctggaaagtgggctattgcgttgcacctgcgcccatcagcgccgagatccgcaaagtgcatcagtatctgaccttttcggtgaataccccggcgcaactggcgattgccgatatgctacatgcagaacctgagcactatcttgcgttaccggacttttatcgccagaagcgcgatattctggtgaatgccttaagtgagagtcggctggagatcttagcgtgcgaaggtacttactttttgctggtggattacagcgccgtatctacgctggatgatgttgagttttgccagtggctgacgcgggagcacggcgtagcggcgattccgctgtcggtgttttgcgccgatcccttcccacataaactgattcgtctctgttttgccaagaaggaatcgacgttgctggcagcagcagaacgcctgcgccagctgtagttatttaaccgtccaggcgcgggaaaattgacggtcggcaaacaactcttgcaggccgttaatttgcttcaggcgcaacacttcgtcgctgtccattcccagctctttgccaattttattatcgtcccatcccaactggctgagttctcggacgatttctgacatggcagtgatttggtgacgtccacgagcgcgattatgacgaatagtcgcggcgatgcgttgattacgcgtaccttccagacaggtcaccggcaaataaccttttaagcgtaattttaacgatgatgagcctttaccaatttcatggcggtgaaaaccatccacgatttccagggcatttttatccgtatgcgtgaccacaatgggttgggtaaaaccatctatttcaatggattttttcagcagttttttttcgggtggtgccacgttgtttgggttgtaatcattaggcataagttggctgtttttaacccacagaacgcaatccactggctcttcacgaaaggggctaacctgatggatcgccatgcggatttcattaatcgctttgatgcgatcatcttccggcaagctggcgagaaattgggttaaatcctgcgttaatcgttgttgcatagtatcccccattcctgacgttttccttttatccgttcgttataacgctgatagttcttcgctttcgtaggactaaatgataatgcccggcaccagtaatcgttattgagtaaaactttgcatattcgccgccaggaggggatatctttcgcgccaatgtccccttgctgggtttgtggaacttcgatgccttttttctgataccagtgcaaataaatagcgattttattgcggtaatgctcagccgttttttccggcatgctattgagcagcaataatgcatattcttgccagtctaaatgttctggcttgaggattttccgatgaccataaaaatgattatcatgtccggcgtaaatgccgccactttttaccccgctgactcgtgcgcacatagcagcccagcgatccggttcgataacgtgatagagccataatccttgccgttgctccgggccaaaaggttcgcaaattcgcatatgacgcagagggacgcctgcctgatacattatattatacagtgggttacagagctgttgatggttagcataccaggtccagatatcagccactttccagtcgtagatggggtaaatgtaccagctatgaccgcctggtgcggcggtggtccagggcttatcatcggcaaaacgttgtttatttaaactggcgatggcgacaaaacggttgtaggactcatctgcacggatgccgatcatcatcgccgccggacgcttttgcgaaaaccattcggcaaactcacgcacaaattgttcgaaggtcataccaggctggtaaaaggagaaaaagtcaggatcggttatcgcatcttgcgggggctgacgcacccattcgacatcaggttcccagcactgccattcgggttggtattgagaaagggaattttgcgtcgtaagcgggagcgcaacccagtaaaactcttcgatgacatcggcgtaaaactcacgtaatgactgaacatagttaatagtgcatgagaactgcgcttcccagtcgataaacaaaacgcagatttttttgcccatttgtcgggcaatttcagctgtcagatgcagcattaatccggaatctttaccacccgaaaaagaaacacagatacggggtagggtattaagtgtccaggtaatacgttcttttgcagcttccagaatattcagtggaagcgggattttataaatagacatctaaaaacgctctctgaacgttacggggtgactcgtgagatgaatccgctaattataggataaacgaagcaagatagagcacattattttatattcacacaatgaattaattgatgcgtaatatattatttgtcagtggtaatgaatcagaagctatcatttaaacgatctatgaatcgggagaagacaaggttgttcaacgaagccttgttataggaaatataaagtttaaccgcaggaagaggttgttccagttttatttcttttaacttcaaaaagtcacgatgtaaatcgtacagttcggtgggcacaatgcctaataagtcagtaacagaaatactattaattatagtcatcaaagaagaactgcgaaatgaaactttacggttcataaaacgttcatctatgtccatttgaatttcgtcaatccctgctgatttagatatcaacagggtgaattcttcggcgataatttgttcatagttactggtatcagtaatacgaggatgtttgttgctacatataagggaattgcgaatagtgtgtaacggcatgcagatgacagagcgactaattactggttgcagcgtaattgccaggtcagttttgcgttgaaccaacagttcttcggcattttcagctgaaagcagtatgtcatggcattctatatcgattgaagtatcttgtctaagacagcggattagcatgttgttattagtacaagaaataagctgaggactgtagataataaaatttttctttagttcagacttattaacgatattgatcgtttgttcaaggcctctgagatttttctcaagatggtgatgcaggtttaaccctgttgtagtcggcgcgatacctttccctgagcgaatgaataacgggtcattaaattgcgcacgtaaacgttgtaacgactgactaacagcagagggcgttatatataatgattctgccgctttactaatgctgagatgttgataaatacattcaaatatgaccagtaaattgaggtcaaatttttttagatcataaagattagccataacatactccgttgtattgtctcttccataaatcattcacttgatcaataatgttgttgtatttatatgtattatgtttttctgcttaactttggattaagattttctaaaatagcatagctgtcaggtgggttacgagcaattcatgcgtttttaggatggttgaaaagcagagagagatttcaaccatcgatgaattatattctatttattccccataatgatattaagtgttttctgatcgggaaatccgacggcttgttgcagggtattttccttactcatgtaatagatagctggtgtgacatttgcccccagatcgtccatgagtttctcgttgtcgcttaacactttcatttgctctgtgcttacgtttgcaggcacgcttagcttaagcttgccaccagaggcttcatattgttgccaggtttttgcgggctctttggaggcaagaattgccgctgctgtcgccgggctttctggcttgataaccccaaccaacaatgttctcaattgcactttgccagaatctacccacggacgagcctgctgccagaactgtttacaatatgggcagaacggatcggcgaagacgtagacaatgaccggcgcgtcttttttaccgtcgaggagccagtgggattgttccatccgttgccacatttcacgtccggcgggtgcgtaaatttctttttcgataagcgtgttactcaggttttcacctttttcgttgtacatgtaaccagagatagcgtgcttaccatctggagtcaggtagatggtgacgcccatatcctgatacttaccgagataacctttcattcctccaggggcatcgaacgttttgatgattgtaataccctgtttttcaatcgcttttactggggaaggaagttcctctgcgaaggcgattgcaggaagcagggccagtaaaagtatcttttttaacattaatttgtccttttcagtcagtgcaaaagtcgggtaaaaggcataacctatcactgtcataggtaagagcttagatcaggtgattgccctttgtttatgagggtgttgtaatccatgtcgttgttgcatttgtaagggcaacacctcagcctgcaggcaggcgctgaagataccaaagggtagttcagattacacggtcacctggaaagggggccattttactttttatcgccgctggcggtgcaaagttcacaaagttgtcttacgaaggttgtaaggtaaaacttatcgatttgataatggaaacgcattagccgaatcggcaaaaattggttaccttacatctcatcgaaaacacggaggaagtatagatgtccttgattaacaccaaaattaaaccttttaaaaaccaggcattcaaaaacggcgaattcatcgaaatcaccgaaaaagataccgaaggccgctggagcgtcttcttcttctacccggctgactttactttcgtatgcccgaccgaactgggtgacgttgctgaccattacgaagaattgcagaaactgggcgtagacgtatacgcagtatctaccgatactcacttcacccacaaagcatggcacagcagctctgaaaccatcgctaaaatcaaatatgcgatgatcggcgacccgactggcgccctgacccgtaacttcgacaacatgcgtgaagatgaaggtctggctgaccgtgcgaccttcgttgttgacccgcagggtatcatccaggcaatcgaagttaccgctgaaggcattggtcgtgacgcgtctgacctgctgcgtaaaatcaaagcagcacagtacgtagcttctcacccaggtgaagtttgcccggctaaatggaaagaaggtgaagcaactctggctccgtctctggacctggttggtaaaatctaaatttcctttgtctttcgcgctactaactccggcgcgagatacttcggaaattcacctaattcttcgggtgctgcggcacccgattttcttccccgcaccatgatgcaagctgcatccaggtagccgcagaggccgcttgcatgatgatgtttaaagcccaggagataaacatgctcgacacaaatatgaaaactcaactcaaggcttaccttgagaaattgaccaagcctgttgagttaattgccacgctggatgacagcgctaaatcggcagaaatcaaggaactgttggctgaaatcgcagaactgtcagacaaagtcacctttaaagaagataacagcttgccggtgcgtaagccgtctttcctgatcaccaacccaggttccaaccagggaccacgttttgcaggctccccgctgggccacgagttcacctcgctggtactggcgttgttgtggaccggtggtcatccgtcgaaagaagcgcagtctctgctggagcagattcgccatattgacggtgattttgaattcgaaacctattactcgctctcttgccacaactgcccggacgtggtgcaggcgctgaacctgatgagcgtactgaacccgcgcatcaagcacactgcaattgacggcggcatcttccagaacgaaatcaccgatcgcaacgtgatgggcgttccggcagtgttcgtaaacgggaaagagtttggtcagggccgcatgacgttgactgaaatcgttgccaaaattgatactggtgcggaaaaacgtgcggcagaagagctgaataagcgtgatgcttatgacgtattaatcgttggttccggcccggcgggtgcagcggcagcaatttactccgcacgtaaaggcatccgtaccggtctgatgggcgaacgttttggtggtcagatcctcgataccgttgatatcgaaaactacatttctgtaccgaagaccgaaggccagaaactggcaggagcgctgaaagttcacgttgatgaatacgacgttgatgtgatcgacagccagagcgccagcaaactgatcccggcagcggttgaaggtggcctgcatcagattgaaacagcttctggcgcggtactgaaagcacgcagcattatcgtggcgaccggtgcaaaatggcgcaacatgaacgttccgggcgaagatcagtatcgcaccaaaggcgtgacctactgcccgcactgcgacggcccgctgtttaaaggtaaacgcgtagcggttatcggcggcggtaactccggcgtggaagcggcaattgacctggcgggtatcgttgagcacgtaacgctgctggaatttgcgccagaaatgaaagccgaccaggttctgcaggacaaactgcgcagcctgaaaaacgtcgacattattctgaatgcgcaaaccacggaagtgaaaggcgacggtagcaaagtcgtaggtctggaatatcgagatcgtgtcagcggcgatattcacaacatcgaactggccggtattttcgtgcagattggtctgctgccgaacaccaactggctggaaggcgcagtcgaacgtaaccgcatgggcgagattatcattgatgcgaaatgcgaaaccaacgtgaaaggcgtgttcgcagcgggtgactgtacaacggttccgtacaagcagatcatcatcgccactggcgaaggtgccaaagcctctctgagtgcttttgactacctgattcgcaccaaaactgcataagaagaagtaagattcacctgcaattgcttagccgccggggtcaaacctggcggcttttttattgcattaaaaagccctgcagggatggctccgggcagggcgggatacttattctggcaattaacgcacaaccagcaccggcaaattggcgtggcggatcacgctcgaggcgttagaacccaacagatgagttgaaattgatgggttacgcgaaccaatcactactacatctgcatcaagttctttcgctaactcgttaacttcatcccgcacactaccaaaacggacatgttgcttaatgcgggaaggatcgatggtgaagtggctgaccatcgtttgcagacgttcttctgcttcatgttgcagatgctcttcaaaacgacgtacatcagcggcaaaacggtgcaggctcaggctggctgaccccggtagtacgtgaagtagatgaataactccgtcatcctgggcgaggaattcagcgtggcgaatcgctttgtcgctcaattccatttcgaaaacatccactggcatgatgattgttttgtacataagcattctctccttgtttttgcatgtatacataacagcacattattggttatgaatctataatttgcgaggctgatttgatctgaatttgctattgagctggaaaataaataaaaaccaggcgctaccagcgttgttcaaggtatagcactgcagcaacaataattgctgctatgaatatataaaatgcagtgataccgagagcttcgctcatatgaggttccgcagatgaataaccagttcagattagaatgctgcgcttaagagcaaaatgataaatctggttgatatttgagcggaaagaggatgcgagtgcatcctctgggcaaagcgagttatcgcttgtgcagatgggattaaagcaggtaatcgccagcagcttctggctggtattcgagttccagcacttcaaggtgggttgcaacgccgcccggcagttcccagtgaatggaatcgccaacgcgcagccccagcagtgcggcacctaccggagccataacggaaagctgagtattgctgtcggtcatttttgccggatacaccagcgtgcgcacacgcacttcgccatcgctaagattgcggaatttaacccggctgttcattgtcaccacgtcgtgtggcatctcttctggcgaacacatttgggcgcgatccaactctgcgtttaacgcgtcggcgattggcaaaccagcataggcgggttgctccagcagaatatcgatgcgttcggcatccaggtcgttaatgatgatagttggtctggacatttttactccatgtcgtcggtactgcgagtgtcgcagataaacatacccaaaagaaaaccctcaccgtcaggcggcgagggtttaactcacatgatgatactgactgttgctcactctttgaagtgatttgcgtcacattcagggaattcctcaatgtagcgcattatgtataaatcttaatcgtcatggtttatggaagacgaattagcgtgttttgtaaatcagaggattaataacctgctttatcaatcacaaaggttttgccacagttgcctgggtgtggttgtggcaagaatgagttggcagaaagcggagcgttgatggcgtcagctttgatcgagatctgaatttcagtcaaatacgcagggttaccctggcacgttagcttaactgctttcacgttctcttttccccagcttttggcaaaggcggcatcaaagtcacggcggctcactgttttaccgtagttatccgcaaggaattttccggcttcgctctctttaatttcttgattcaggcgtaccatcgtgccgaagtatgcgtctggatcaaaaccaaagcaggcaccgtgtttggcatattcgtagcgttccaggcaggaacgtccgccagctcctggcatgacttcacttagtttagcggccgtttccagtgataacccggtttccggcgatgaacacattcggctggcgcgcgcttctggtagattcgggattgggcgagtagcgcaaccgaagcgcatccagcggcgttcatcaacaccacgggcagcaaccgatttaggcaatcctggccacagaccatgtacggtcagaaaatcagctttgttggtcgtttcggtttgcaggcgacattcatctcgttcgttacgatttcgatcgtgttgactctggcaaaatccggtttgccaggagagggccaggacatagcgatcaaaatcgccatactgttttgcctgcaacgccacggcgttggcagaagagaagggaagcagagaaaccgcgagcaacgcggcgttacgccagaatgctttcataatgggtgtggaactcatacatacactgaatattatctattaaatcataaaaaagcccgcctggtgggcttacctggcgggcgtgatgatttattcagcgtttggcgaacgtattagttccacatggcgagaatcggccagccaaccaacagcagcatagagatgtaaatcaccccgaagattgcgccaagacgccagtaatcttttgatttcacatagccacagccgtaaataatcaccccaggaccggttgcatacggcgtcagacagcccatgataccgatagacagtaccagcaggatacacagttgttccattggtacgcccggaatccctttaccgacggccagaataaccggcagcatggttgcggtgtgcgcagacaggctggcaaacaggtagtgtgcaaagtagaacaccagaaccagtacaatcaccgttgcgtttggtgagaagccttccaggtgtgtactcatcgtgttggcgaaccagtcgataaagccagaacgggtcaggccattcgccataacaaccagcgttgccaggttgaccagcgtgttccatgcgctgttatagcgagtaatgtctttccacggcacaacgtgcagcgccagcatcagcgaaactgccagcagacctaccgcagtagcattaatgacttcactgccaaatacccacaaacctaagctgagcaatacaaggccaatcagcgtccactctctgcgcgtcagcgcacccatggtttttagttcatcacccgcccaggttgccacttcttcactgtgtgtgatttccggtttgtacagcacgtaggaaagccacggcgcaatgataagcaagataaccccaaccggcaggaagcagaggaaccactgcaaccagctaatctggataccggcaattttgctgacgaactccagacccagcacgtttggtgccgcaccggtgacaaacatggacgaactcagactggtactaatgaccatcatccacatcaaatagccgccaatacgacgcgcggacggatcgttcgggaatgatttaaacagcggcggcaggtttttaatgaccggaaaaaccgtacccccggtacgcgcggtgttggacggtgtaaacggtgccagcagaatgtcgataatgacaatcgcataacccaacgtcagcgtgcgtttgcccatgaatttcaccaggaaaagggcaatgcgacgacctaacccggaaacttcataccctaatgcaaaaataaatgcgccaaataccagccataccgtggtgctggaaaaaccagccagaccccattgcagcgcctgtttttgcgcattaaacgctgggtcagctaattctttggcatcaaagagcaggtaattactgccaataacgcaaatagtaaccgcaataaaactgatcgccgttgccggaattggctcgaggatcatgccgacaatcattgccacaaacactgcaaagtaatgccacgcctgcggcggcataccgtcaggtacagggataagaaacatgacacccatcaccaccaggggcgccaataatttccatatattatcttttgctaaagacatacgggttctccgaaaattaatatttccaaatttatcaagtgcttaaataattaaatctgtgctaaaaaccaggtaagaatcagcaggtcggcactgccgcctggactgatatttcgttcgatacactccctgtcgaactgccggagataatcgagatcggcgggggttcggatgcccccattgtttaataatgtttgcgcctcgcgctgtagccagcgcaggcccccctcgccaccgcgcgatgcaacgttggtatcgccgttggtagccatcagtaggagcaaggtatcgagcaatgccagctcaggatctaacccctgatccagcagagtgaggtaatgcggcaaggcgtggttgatcaccagtggataacccgcttcggcttcaccgcgtgcgccggtaaggccaagctgctggtacaaccgttgacctgccgtcagttgtgaattattggtacgcagttcgcgatcggtcaggccacggcagaaacttgccgccgtcgcacaaattgttattggcgttaccgactggttgagttgaagcaaacggccaattgccgcacacagtagccctaaagaaaaaatgctgcctttatgcgtgtttacgcccgcagtggcgcggaacatatcaccttcgcaagccataccaattgggcgtaatccgttgagtaccgcttccggtgccatttctgcactacaggcaccaaattcaatgaaacggggtaaccagccctgaatcgccagcgcgctgcggtggaaatcttccagcgccatatctttgtgcgcaccgcagttaatgcgatccacgaggcctggtttcggtgacaggttgacttcagtcagcatggcgcgccagcccagcagggcgtactcatcgattaatgacgtcgcaagctttgtggttttagttgacgttgcaggcatcgacatcgttcagcagcgcctccatgcggttgagtaaatcggtcagttgatgggtttttccacgcgcgcaaacagctgcgctttgctcgcacaacaggcagcggcgaggcggcagtgaataatcgcggcgggagagaatgtcgccttcgggcgtcaggacatcgatatcccataaccgcccgagaggatgactatgttcaagctcaatggtggcgagcttgaggtcgcgagccggggcggcaatgctcaacatgccctccggcccgctggcggaaaccagtgcagcctgctcctgaatttgccagccctgttttgcggctaaggcacgcaaggctgtcacgccatgattaaaaattcggcgtgtgacctcgctgtctttaatcggcccaggcgcaaccacggtaaaggagaccagtggaacaggatggcgcttgagccaggcgtgttgccgtgcttgcctttcatcccggctgacgagcagctcgggaattgacaccgcatggtggctggcgagttcaggaagcaggtgcatggcttattccttcacctgatgcacaacatcgatcaccgagccatcgcggtaacgcacaacggcaacgacgcggtcggtgaattcaatcggctgtggttcaccggtcagcagacgcgcacgttcacgcagccactcaatagaaaccactttgatccccgcttcctgcagacgttctgccagctccggacgtgccgggttaacagcgatgccgtggtctgtgaccagaatatcgacactggagcccggggtgatgcaggtcagcacgttatccaccagcgtcggaatacgaccgcgtaccagcggcgcgacgatgatggaaagcgcagaagcaatcgcggtatcgcagtgaccaccggaagcaccacgcagtacgccgtcagagccggtcagcacgttaacgttgaactgggtgtcaatttccagcgcgctcagtaccaccacgtcgagacgatcaaccgctgcgcctttcgacccccagttagcgtactggttggcgctgatttcgatgtgattggggttacgggccagcgattgcgcagcatggctgtcaaagctctgcacatccagcagtttgcggatcaaacctttttcgtgcagatcaaccatcgttgcggtaataccgccgagggcgaagtcggcgcgaatatcgcggctacgcattttgtcttccaggaaacgggttaccgccagcgaagcgccgccggtgccggtctgcatggagaaaccttctttgaagtagccagagttaacaatcacatccgcagcgctacgggcaataagcagttcgcgcgggttagtggtcatacgggtagcaccagcgccgatttttgcagcatcgccaacgcgatcaactttgacgatcagatcaacctgatcttgctcaatgcttgccggattatgcggataaggcagcagttcttcggtaagcatcacgacctgttttgcgttgtcggcatcaaccattgcatagccgagggagccgcagcaggctttaccggagtagccgttggcattaccgaattcatcacaggacgggacgccgaggaaagccacatcgatattcagttcgccgctctgtaccagatgcacacgtccgccgtgagagtggatttgcaccggttccgccagcagaccacgggagatttcttccgccagtggaccgcgcaggccagaggtataaatgcgggtaaccacgccctggcgaatgtgttctaccagtggcgcatggcaatcactcagggagctggaggccagagtcaggtttttaaagcccatcttcgcgatgacgtccatcaccatattgacggtcaggtcaccgccacggaaagcgtgatggaaggaaaccgtcatgccgtcctgtaaaccagagcgacgaatcgcttcttccaggttggcgcacagtttgcgatcgcgcgctttttcagcctggtaggtttgctttggcgagttctggaaagcggcaagatcgcattcagcgcgacgattccaggccgctacccgttcttgtcgttgagattgttcaattttctgcgtcattttgattgccttattcttcgcggatgccggaaagttctgcgcgggagagcaccagacgggcgcgatcgataaccggaccgtccaccatcttgccgttcagggaaaccacgccgaggccttcgcgagcggcggcttcagcggcttctacgacgcggcgggcgtgatccacttctttctgggtcggtgcgtagaggttgtgcagcagatcaatctgacgcgggttgatcagcgatttgccgtcaaagcccagctgtttgatgtgggcggcttcttgcaggaatccggcttcgttgttagcgtcggaatagacggtatcgaacgcctgaatacccgcagaacgcgcggcctgcaaaatggagcagcgagcgaacagcagttcagttccttccggggagcgttctgtacgcaggttgcgcacatagtcttctgcaccgagggcgataccgatcaaacgctcggaagcgtgagcgatttctaccgcgcgggtaatgcccagcggagattcaatcgccgccagcaggccggtactgccgggttcacgaccacaggctttttcgatacgcaggatctctttttcgatatccagaacatcctgagcggtatcggttttcggcagacgcacaacgtccgcaccaccgcgaacgacggcttccaggtcgttaacaccccattcggaatccagcgcgtttacacgcacaatggtttcaatatcgcgataaagcggatgttgcagcgcgtggtaaaccatgcggcgggcggtgtctttttcacgcaatgcaacggagtcttcgaggtcaaacatcagggcatcagccgggtagatgaaggagttgctgaccatcgcggcattagcaccaggcacaaacaacatactgcggcgggtgcgagttttacgttgttgcagcgaagcggaaatcattggcaatcctcccatggcagagccgggataccgctggcgcgtgccagcagggcttccagtcgtgcacgtaaaatgcagtccagtgcgcctttgtcatcgacattcagctgtacgccgcgcacgttgtagcgggcgagaacttccagaatggtggtgcgaattgcatcgccaaactgtttctcaacgctgctgttgatttgcaggtcgatatcctgcgtatcgagtggggcgatgcgtatcatcacatccccagactcaagggtgcctgcaacggcgggctggtttattttcatttttcacctgtttctcatgcgggggtcttttgacgagctgccgcgtcctggcgggagtgctcaagcaggttctgcaaataatgcagcgtgactgcagggaccagcggcgcgatagccgtgagatcgttttttgccagcagttgacgtacccgggaagcggatatcggcatctcctggtaacgcagccgctcaatttcaaccagttcgatgggcggtgcggagatagtcggtgtttccagccagtagcgcatatcctggttgtactgggcagtaacgcgacaaaagggttcagtaccgacaaagcggtgagttacacccagcgcgggagcgaggtactgacggaaaatcttcagatcaatttcggtgtaacaatggttaatgacgctctgttctttaatgaagtagcaagggaacgtagcgcgggagatgatgtattcggagccgcgatgcacagtcaggcgtggaatatcggcggtgccttttaacaccagatccagccggtcttcataggggaagcgtgaagaatcttctttgactaaaaacagatgcaaccagtcgcactgtgccgcagcctgttgaatcagataacggtgaccattcgtaaagggattggcgttcatcacaatgcagccaatcttgttccctggatgacgaaattttttcagcgattcggcatagcgtttcagtcgcgtggcgctgttttccatcagcaccatcacgccgggtacgctggtcagcgtggaaaaaccgcactggcggaacagcgcctcgtattcggttttggtataaataaacagatgcatgctatgccgctcataggcgaggtttatcagttcagtggctaatgtcagcgccagtccttcaccgcgaacggattcactgatagcaacgcatttaataatatttccggcaattccaccgcacgcgataagcttttcatcgcgggttacggtaataaatacttcgactgtggtgtcaacgctcaaatcattttcatgcaggaattgggcgatttccgccatttttttattttctgaacgttttacgcgggtgaaaatatcattgccgaacataataaatagtatcctgaaggtgcatgttgttatcgatttgcaacgaatgttgttcaatgttgcaaattgataaccttttattttcacttgggagaaaggggggcgatcgaggtatatctttttctcctttcgctatacatcttaaggagtatttcggcgtgaaattttgatttatttcacatagagttagtggttttttatttatttaatggttttaagttttttaactaatgtaattacgaaataacccgcaggtttaagtgatttaattgatttaatgaataaaatttgccacgatcatatttaatatctatgtattttgattcaacattttaattacatccgtcaaagaggctcgggacaacccgcaaggaaaacaatgttgcagcttaaagagaataaacagtttgcatttttccaaagactggcatttccgctgcgtatctttttgctgattctggtgttctcaatatttgtcattgcagccctggcgcaatattttacagccagttttgaggactatttaacgcttcatgtgcgcgacatggcaatgaatcaggcaaaaattattgcttctaatgacagtatcatcagtgcagtgaaaacgcgtgactacaagaggctggcgaccatcgctgacaaattacaaagagatactgatttcgattatgtggtgattggcgatcggcactcgattcgtctttaccatcctaatccggagaaaattggttatcctatgcagttcaccaaaccgggcgcgctggagaaaggggagagctacttcatcaccgggaaagggtcaattggcatggcgatgcgtgccaaaacgccaatctttgatgacgatggaaaagtcatcggcgtggtgtcgattggctatctggtgagtaaaatcgatagctggcgggctgagtttttattaccgatggcaggcgtgtttgtcgtgctgttagggattttgatgttgctgtcgtggttcctggccgcgcatatccgtcggcagatgatgggcatggagccaaagcaaatcgctcgcgtagtccgtcagcaagaggcgctgtttagttcggtttatgaagggctgattgcggtggatccgcacgggtacattaccgccatcaatcgtaacgcaagaaagatgctggggctgagttcccccggacggcaatggttgggtaaacccattgctgaagtggtcaggcccgccgatttctttaccgaacagattgatgaaaaacgtcaggatgtggtggcgaactttaacggtctgagcgttattgccaaccgggaagctattcgttctggcgatgatttactgggggccattattagctttcgtagtaaagacgaaatttccaccctcaatgcgcaactgacgcaaattaaacaatacgtcgagagccttcgtacattgcgacacgagcatctcaattggatgtcgacgctcaatggtctgttgcagatgaaagagtatgatcgcgtgctggcgatggtgcagggggagtctcaggcccagcaacagcttattgacagcctgcgtgaggcgtttgccgatcgccaggtggcggggctgctttttggtaaagtgcagcgcgcccgcgaactggggctaaaaatggtcatcgtccccggtagccagctttcgcaactgccgccaggactggacagcaccgagtttgcagccattgttggcaatttacttgataacgccttcgaagcaagcctgcgtagcgatgaaggaaacaagatcgttgaattattcctcagcgatgaaggcgatgatgtggtgattgaagtcgccgatcagggctgcggcgttccagagtctctacgagacaaaatatttgagcagggtgtcagtacgcgtgctgacgagcccggtgaacatggcattgggttgtacttgattgccagctacgtaacgcgctgcggtggtgttatcactctcgaagataatgatccctgcggtaccttattttcaatctatattccgaaagtgaaacctaatgacagctccattaaccctattgatcgttgaggacgaaacgccgctggcagagatgcatgcggaatatattcgtcacattcccggattcagccagatattactggcgggaaacctggcgcaggcccgaatgatgatcgagcgttttaagccggggctaatcttgctcgataactatcttcctgacggtagagggattaatttactgcatgaactggtgcaggcgcattatcccggcgacgtggtgtttaccactgctgccagcgatatggaaacggtgtctgaagccgtacgttgtggtgtatttgattatctcattaagcccattgcctatgaacggttggggcaaacgctaacccgtttccgccagcgtaaacatatgctggaaagtattgatagcgccagccagaagcaaattgatgagatgtttaatgcctatgctcgcggtgaacccaaagacgaactgccgaccggcattgaccccttgacgctaaacgcggtgcgaaaactgttcaaagagcctggtgtgcaacatacggcagaaacggtggcgcaggcactgaccatcagtcgcaccactgctaggcgttatcttgaatattgcgccagccgccatctgattattgctgaaattgttcacggcaaagttggcagaccgcaacgcatataccacagtgggtgacatgataaagccggaggaaacttgcctccggcattactatttacttgcctgtgaccgctgctgccgttcctggcaccatcagctctgtagcaacgataacaatcaccaaaccaacaagcaccggcaccgaggtgcgttttacgacttcaaacggcgagatcttcgccatcccggcaaccgcaacgactacgccagaaacgggtgatagggtacgacccaggtttgacgcctgcagcatcgggatagtcaaatacgccgggttaatgccggaggagtgcgccagtttcgggatcatctcaacaaacgcataaaacggcgcattgcctgaaccggtcgtgactgccgccagcattgtcaggatcaccaataccagcatcaggatgatactcgccgaaccaaacgaggtagcgatagaaatcagactttgaataaagccgatggtgctaagcccctgagcgaataccccagcggcaaccagcagcatcaccacgttagcaaatgcatctgccataccgcgataagccacttccagaccagagaaaactttctgggtattaaagctgcggatgaactccagaatggaggcaattagcatacaaatcaccagaatagtgatgatgtgtaattgcggaccccatttgccgtcaaaaatcagcactccgatgatcggcgtgaacggcaaaatggcataaaacgcaggggcagtggtggtgatttcactgacatctaacatttcatgagagatgtgctcttttttatccagataacgttgccagaagaagtgggcgatcgccatgccgataattgcagcaattgagataggcagcgttgttttgaaggcgaagtcaatcagcgacatttcggaagcctgcgccgccagcaccacatcccctgaagtcggtgcgagaataatcgccgccggggaggcacaaatggcagcagctgcgccacgactgataccaacgtttaccatcaccggaaacagggttgccatcagcaaaacacccagaccggttgcggaagagacagccagtgacatcagacaggcaacaaaataggcggcaatcatcagaaggtaaggggagttaatatactgcaatggttttgacgccagcttgaccaccatatcattcgcgccgatatgggtcatgtaagcggcaaagccacacagcatcataatcatcatgccgaggtcgccgccgcggctcattagcaatattttaacgtattcaacgatatccgtggcgctgtagcctgttgaagcctggctggacggtaacactttgtgccccataatggcactgataatcagcaataacaggccaccgacaaataacacgccagtggcagaataccctttaatgatgtagcgagctacacccacaataaccacaaccccaataaggagttcaatgaatgtcagcataatttttcctgtctccaggccccaaagtaaataataaaaaattcctaaaagttaaggaaaaaatatgcccaataaattggcggtgaatgctgattaaaatcaagaaaaactgccattaagacattgaagttgctgtttttatacgtagataacaaaacgcatatttagcggttggcaaatatcacataataatgtgtgtaaattgatggtggattgatgcaaatttgttaattgtaaggtgttagctgcggttgtgtgctcaaaaaataatcttccatgagcatgggttgacgatacataatatattttttgttaagatattttttatatcttattaaaaaataaagtaatttttatcggttgtactttgttatcagaaacgacttggtttttcttttatgactattcccatcgcagaaaacgatgcatcgtctttaatcgatgcgcggaaatatttatcttgaactagcggaaataaatagagcagctatttatattattcttcatgttggggctattgaggttatgttaattgtagctttgctatgttagtagtagatttttgataaatgtttaatggtcacaaatgaaagtgagtaaatatgtcgctatatttttctttgtttttattcagttaatcagtgttggtaaagtttttgctaacgctgatgagtggatgacaacgtttagagaaaatattgcacaaacctggcaacagccagaacattatgatttatatattcctgccatcacctggcatgcacgttttgcttacgacaaagaaaaaaccgatcgctataacgagcgaccgtggggtggcggttttggtcagtcgcgttgggatgaaaaaggaaactggcatggcctgtatgcaatggcatttaaggactcgtggaacaaatgggaaccgattgccggatacggatgggaaagtacctggcgaccgctggcggatgaaaattttcatttaggcctgggatttaccgctggcgtaacggcgcgcgataactggaattacatccctcttccggttctactgccattggcctctgtggggtatggccccgcgacgtttcagatgacctacattccgggtacctacaacaatggcaatgtgtactttgcctggatgctctttcagttttgagataaatgaagttttagtaaatcctttaaaatcaaccactaaaataattaacatcaaaaataacgcgacttttatcactttttagtaaagttgcactggacaaagcgtaccacaattggtgtactggtaaccgacacagcatttgtgtctatttttcatgtaaaggtaattttgatgtctaagattaaaggtaacgttaagtggtttaatgagtccaaaggattcggtttcattactccggaagacggcagcaaagacgtgttcgtacacttctctgcaatccagactaatggttttaaaactcttgctgaaggtcagcgcgtagagttcgaaatcactaacggtgccaaaggcccttctgctgcaaacgtaatcgctctgtaagatacgtcagcaagaattcaaaacccgcttaatcagcgggttttttttggtctttagtgtgtggttgaggccgaaaacagccagaaagccagtgcggtcatggcaaaagaccccaaaagattgacgaaaacgttcagtaacgcccagccaaagcggccctcttgtaacaaaaacaccacttctgccgaaaatgttgagaaggttgttagaccgccacaaaatccggtggtgattaatactttccacactggatcaatgttcgtcatcctgctgaaccaggcgaatcccattcctatgatgaatgccccaatcaggtttgctgccagcgtccccaacggaatcgcctgatgcagcgggttaaatcgcatacttaacagccatctcgccacgcttcccgtaccaccgccaataaaaactgctaaaagaagttgtaacactgcaaaatcctgctatttgatttgtatgagtgataagtgtaacgccgaataatcgccgttggcgaattttacgactctgacaggaggtggcaatgctggttgccgcaggacagtttgctgttacatctgtgtgggaaaagaacgctgagatttgtgcctcgttgatggcgcaggcggcggaaaacgaggtttcgctgtttgtcctgccggaagcattactggcgcgtgatgatcatgatgcggatctttcggttaaatcagcacagctgctggaaggcgaattcctcgaccgtttacggcgagaaagtaaacgtaacatgatgacgacaattctgacgattcatgttccttcaacaccggggcgcgcgtggaatatgctggtggcgctacaggcaggaaacatcgtcgcccgttatgccaaactgcatctctatgatgcatttgccattcaggaatcacgccatgttgatgctggtaatgaaatagctccgttactggaggtggaagggatgaaggtcggtctgatgacctgttatgacttacgctttccagagctggcgctggcacaggcattacagggagctgaaatcctggtacttcctgccgcctgggttcgtgggccgctcaaagagcatcactggtcaacgttgcttgccgctcgtgcgctggataccacctgttatatggtggcggcgggggagtgcgggaacaaaaatatcgggcaaagccggattatagatccctttggcgtcaccattgcggcagcgtcagaaatgcctgcactcattatggcggaagtgacgcccgaacgtgtgcgtcaggtacgcgcgcaactgcccgtcttaaacaaccgtcgctttgcgccgccgcaattattatgatgtttttttactcggcgcttgattcaccttgttacagattgctattgtgtgcgcgcgtcgaatgaccgttaatattctctggtttttaaggcgcgttctgttgccggttatatgtcaagaaggtatctatgggtgagattagtattaccaaactgctggtagttgcggcgctggtcgttctgctgtttgggactaagaagttacgtacgctgggcggagaccttggagcggccattaaagggttcaagaaggcgatgaatgatgacgatgctgcggcgaaaaaaggcgcagacgttgatcttcaggctgaaaagctctctcataaagagtgacgtggcgagcaggacgctccctcaatatcttgttcgatacaaaaacccgcttcaaaaagcgggttttttatcagacagatgtaagtaattattacaggattacttaacttccatccctttcgcctgcaaatcggcgtggtaagaagagcggacaaacggaccgcatgcagcatgggtaaagcccatcgccagcgcttcggctttcatttcgtcgaactcatccgggctaacgtaacgttgaaccggcaggtgatggcggcttggctgcaaatattgccccagcgttagcatcgtcacaccatgacggcgcaggtcgcgcattacctcaataatttcttcattggtttcacccagtcccaccatcagaccagacttggtcgggatttccggatgcgcttctttaaagcgttccagcagcttaagcgaccagttgtaatctgcgccaggccgtacctgacggtaaatacgcggtacgttttccaggttatggttgaacacatctggtggcgttgcagtcagaatatccagagcacgatccatacgaccgcggaaatccggcaccagagtttcaattttgatttgcgggcttttttcccgaatggcagtaatgcaatccgcaaagtgctgggcaccgccatcgcgtaggtcatcacggtcaacggaggtgataaccacataacgcagcgccatatcggcaatggtctgcgccagtttcactggttcattggcatcaggagctaccgggcgaccgtgggcaacgtcacagaacgggcaacggcgggtacaaatagcgccgaggatcataaacgttgctgtgccgtggttaaagcattccgccaggttagggcaggaggcttcctcgcagacagaatgcaggccatttttgcgcattgcggctttgatgccctggatacgtgtagagtccgctggaagcttgattttcatccattccggcttgcgcagcagggcttcgcgctctgttgccacgtttttaaccgggataagggccatcttatcggcatcgcggtatttaacaccgcgttccatcacaatgggtttactcatagcgtgcgtgttccagttgcgaattatgaaggaaagcgtttcaattcaatagattgttgtaattatcaactatttttgaattaacgactggcagtatatcattgaaacggacctgaaagcagccaaagcggtcgcgaaaatgtaaaattgttgttggattgtgccattttatcgttctgcgctgtgatctggctgtaacaatactttttcaaaatgcattacggataacatctatggtcctgtgcaaaacatgttatcggtgatgagatcggtttgaaactgactgagttggttttccgcgccgccgatgggcgggttgcgcagtaaaagctgtggatagtgagttttaatcgcccgatagatgacaggaaggaccagggctccgaccgagggggggcagattaagcactttcgctgcattaacgattcctttatggacatatgcaacttcaaaatagtcagaagggtaagatcaatatttcgtaaggttgtaaatatttgtggtttaccttctgacgattttctgcttaaacagggttcaatttgattattactatccacgcacttactccaatttcattcatgaaaaaataatatttaaaaaaattacaataatcttatgtctaattgggatggaacgcttttgctcaccatggtaattatttcaatgagttaaccaattgggtgagctacggagcaaggcgtagcatcgcatttctgcaagtgataaagaaaatatacaaacgcgaaggagatgtaaagcattagcaggtattatgagtaatgacccagtgtaaattgggccattgatgtatggaattaagcggtaatatattcgaagtcaggattgtttagtagcgctaaaatattttccagtaaacgtggtgcaatattattagtcgtcgcttcgggtttccattgtgatattttagccatttccattcctgcatacccacaaggattaatacgtaaaaatggtgaaagatccatattgacgtttaatgccagaccgtggaatgaacaaccgcgtcgaatacgtaaacccagtgagcaaattttcttttccccgacatagacaccaggcgcgtcagcccgaggatgcgcttctatacccagttcagccagggtattcaccactgtttgctcaagcaaggtcaccagttcacgcacaccgagtttacggcgtttcaggttaagcaacacatacatcacctgttgccccggcccgtgataagtcacctgcccaccgcgatcgctctggatcaccggaatatcacccggcattaaaatatgctccgcctttcctgcctgcccttgggtgaataccggatagtgctcgaccagccagatttcatcaagggtactatcatcgcgggtatcggtgaattcatgcatagcctgggagattggctcgtaaggctgaagaccgagctggcggacaagaattttatcctgatacaaaacggcatctccgtggagaatgagtaaaagtgggggaaaagtatatcacagcgaggagaggggagttacccgaccaggagccgggtaacggagaagcgagttacagaaccatgcggacaatatcgattttgcccagttcttcatacagtgtttcaacctgctcgatatgagtggcgttgatagtgatagataccgagtggtagttgcctttgctgcttggttttaccgttggggtgtagtcacctggcgcatggcgctgtaccacttcaaccacctgatcaaccagctcaggtaacgcctgccccataactttgtaagtaaaaggagtagggaattcaagcagttcgttaagtttggttttcatgtcagctccggcgtaacgtaattaaatagcaactcccgccagaaggcgggagttttttactgatgcttagtatatggggacggaaattacactttcaagtgttcaatttttaaccaaaccagtgatggaacattaatttaatgtaatcaatgattttgccgaagaagttaccttccggtatttcttgcagcacaaccagcgggcgttgttcgatcgttttgccatcaagctggaagttgatagttccgacgacctgattcttttgcagcggcgcatgcaattcactgctgttcagcacatagctggctttcagatctttcatgcgaccacgcggaatggtcaggtacacgtctttatcaacccctaacgaagcgcgatcagaatcaccaaaccaaaccggttcagaggcgaactctttacctactttcagtgggttaacggtttcgaagaaacggaagccccaggttagcaattttttactttcggcttcacggcctttaaaagtacgtccgcccatcaccgcagagatcaagcgcatctggccttcagtcgcagaagcaacaaggttgtaccctgctttgtcagtgtgtccggttttgatgccgtcgacattcaggctgttatcccataacaggccgttacggttcagctggcgaataccgttaaacgtaaattctttttctttatagatcgagtattcattcggtacgtcacggatcaacgcctggccgatcagcgccatatctcgcgcggagctgtactgaccatcagcatccagaccgtgtaccgtctggaagtgggtatttttcaggcccagggcgttaacgtagctgttcatcaagccaacaaaagcgtcctggctaccagcggcaaaatcggccatggcgacacaagcatcgttacccgattgcaggttaataccgcggatcagctgagaaaccggaacctgcatgcccggtttgaggaacatcagcgaagaacctttaaacaccgggttaccggtggcccatgcgtcgttgccgatagtgactaaatcagtttctttaaatttaccggctttcattgcctggccgataacgtaactggtcatcattttggtcaggctggcaggatcgcggcggacatcagcgttctgttcggcgagtactttgccggagttgtagtcaatcaggatgtaggactccgcgtcgatctgcggtacacccgggatcatggttttgatattcaggtcatcggcatgtgcagcagagataaaggctgtgcaaagagccgtggtgagcgccaggcgcttcatgatacgagcggaaaaaatggtattcatggtctgaactacgacatccgtgatggaattaaaaaaagtgccctactatagcaaatgcactaccggcaggcatctgactttccgcgtgactttgttaacgtcatttacagaaattgacacatcagatgcctgctttacgctactgcgcggtggtaataaatgactgtaattgggcttcggtttgcaaacgttgctgcaaggtactggcttcggctttgctggcgaatgggccaagctggatccgccagaccgcgccattttgagttacgcgaccggggacgccgaacttctgtcccagttgctgttggtactgttgcgcacgagcctgatcgctaacggccccgacttgcaccataaagttgccgctggcgctttgcgaggcggcttgcggtgtcaccattgcaggtgaggttgcaggcgttgtcgacggagctgtaacaacgggctgtggcgcaggcgtcggttcgctgccttccagtacaccaggcgctaaggtcgttggtgcgccgaggaaaccgctgctggttaccggcgcgccggtcggatcttcgctttttagcgtcgaattactgaccggaagaatgtcaccctgcgggacaggcactgaacttgttcccgcgccaccgcttaaatcgggaggtgctggcagggcgtaagtctgtttggcgactgtggtacaagccataccaggaccagaaagcgaaccatcctgggcgacaataatcggatcgatacgaactttggtgttgtttgacgtgttaagacggtcagctgccgcgcgagaaagcgaaatcacgcggtcgttgccataagggccgcgatcattaatgcgcaccacgatcattcgcccgttagccaggttagtgattctggcgtagctggggattggaagcgttggatgggccgccgtcaactgtgtcggatcgaaagcttcgccagaggccgtcaggttactgccgggttcggcatcatagattgccgccagtcccgcctggctaaatcgagacggatcctgcacgattttgtagcttttcccgtcgcgctggtaatcctgatttgccgtcgcgttcagtggttcgaaacgcgggtctgccccgctaatttcaactatggggccgttacataccgcaggctgcggtacacttaccgtctgttgctgaccatcatcgcttgtacatgccgcgagcattcctgccgcgatgcagatcccgagccactgcttacgcattgcgcacctcttacacgcttttcgacaacattttcctgtgggtgtggattgacattacaatcccgaacccagccatcagcacaattagcgccgatcctccataactgaccagtgggagcggaacccctacaaccggcagaataccgcttaccataccaatatttacgaagacataaacgaataatatcagcattaagccgccagccatgacgcgaccaaaggtggtttgcgctctggcggctatccacagcccgcgcatgatcagcagaatgtagagagcgagcagaatcaaaatgcccactaatcccagctcttccgccagtaccgcgaagataaagtcggtatggcgttcggggagaaattcaagctgtgactgagtgccgtgcagccagcctttgccgcgtaatccgccggagccaatagcaattttagactgaataatgtgatagcctgcgccgagtgggtctgattccgggtccaggagcatcattacgcgctggcgctggtaatcatgcatcaggaagaaccacagaatcggaatgaacgccgctaccagcactactgcgacgccaatcagacgccagctaaggccagagaggaacagtacaaacaggccggaaagcgcaacgaggattgaggttcccaggtcaggctgtgctgccaccagcagcgtgggcataaatatcagcaccagcgcgatagctgtattcttcaatgaaggtgggcaaacgtcgcggttgataaagcgtgcaaccatcaacggtacggctatcttggcaatttccgacggttgaaaacgaacaataccgaggtccagccagcgttgagcgcctttagagatggcaccgaaagcatctaccgccaccagcaaaataatacagatgatatagagatagggggcccagccttcataaacgcgtggaggaatttgcgccatcaccaccatgatgaccagacccatcgcaatctggccgattttacgctccatcatgccaatatcctgaccgctggcgctccagataaccagggcgctgtaaaccagcaatgccagtaagatcagcagcattgtgggatcgagatggactttatcccagaatgtttttttattcggattatccgtcatgattaatggtcctccgctgcggcaaccgctggattttccgcaggcagatcggtgttgttatcacccagcataatgtggtcgaggatctggcgcatcagcgtaccaaccgccggacccgcgccaccgttctccagaatcatggcgacagccacttgcggattgttgtatggcgcaaaggcggtcatcagtttgtggtcacgtaaacgctcggcaattttgtgcgcattataggtttcgttcgctttcagaccgaagacctgagcggtaccggatttcgccgcaattttgtacggtgcgctggcaaaatatttatgcgccgtaccgttagggcggttagcaacaccgtacataccgtctttcgccagctcccagtaaccggaatgaatatcgccgacgggcggttcatgcggttgtacccatggcacctgtttgccgtcttcggcggtgctcatcagcaaatgcggaaccttcacgataccgtcattaatcaggatcatcagtgccttactcatctggataggggtcgccgtccagtaaccctgaccgataccaaccggaatggtgtcaccctgataccacggttttttaaagcgtttctgtttccattcgcgggtaggcatgttgccggaacgttcttccgccaggtcgataccggtgtaatgaccataaccgaatttccccatccattcggagaggcgatcgatccccatatcgtaggccacctgatagaagaaggtatccgcagattcttccagcgatcttgtgacattcagacgcccgtggccccattttttccagtcacgataacgtttttccgaccctggcagttgccaccagccggggtcaaacagcgtcgtattgcgcgtgatcaccccggcactcaatgccgaaaccgccacatagggtttaactgtagacgcgggaggataaaccccctgtgtggcgcggttcaccagcggtgtattcgggtcgttcagcaaggcggaataatctttgctggagataccgtcaacaaacaggtttgggtcataactaggcgtggaaaccagcgccaacaccccaccggtacgcggatcggtgactaccacagctgcgcggctacccgccagcagcgtttcaatatattgctggagtttgagatccagcgtcaggtaaatatcgtgtccggcttgcggtggtacttcttttaactggcggataacacgcccacggttgttaacttcaacctcttcataaccggtctgaccgtgcagcacgtcttcatagtaacgctcaatgcccagcttaccgatatcatgcgttgccgcatagttggccagtttgccgtcattattcaggcgttcgacgtctttatcgttgattttcgacacatagccgatgacgtgggtcaacgctgaaccgtaaggatagtaacgacgtttatagcctttaacttcgacgccaggaaaacggtactgattgacggcaaagcgagctacttgtacttcggtcaggttagttttcaccggaatagaggtgaaacggtgtgaacgtgcgcgctcttttcggaatgcagcaatatcatcatcggtcagatcaaccacgctgcgcaaagcgtccagcgtttgctgcacgttatcgactttctccggcatcatttctatctggtagatagtgcggttgagagccagagggataccgttacggtcgtagataatgccgcggctgggtgcgataggcaccagcttaatgcggttttcattagagcgggtctggtagtcggtaaagcgaacaatttgcagattatacaggttggcgataagcacgccggtcagcagcaaaatccccaaaaaggcgaccagcgcccggcgcacaaacagcgcggactctgccgtatagtcgcgaaaagagttctgtagtttcatccgctgcgttttctactcaaagctcacttatcactcacggtgataaggatggttggtggtgatgctccacgcccggtacagactctctgcgaccagcacgcgaaccagcggatggggaagggtaagtgccgacagcgaccagctctgctccgccgccgctttacaggcaggcgacaacccttcaggcccgccaatcagtagactgacgtcgcgaccatccagcttccagcgttccagctcagcggctaactgcggcgtatcccagggcttgcctggaatatcgagggtgacaatgcggtttttgcctgcggccgccaacatctgctcaccctctttgtcgagtatgcgcttgatgtccgcattcttgccgcgttttccggccggaatttcaatcagctcgaagggcatatctttcggaaaacgacgcaggtactcggtaaaaccggtttgtacccagtccggcattttcgttcccacggcgacaagttgcagcttcacgcattaactccagagtttttccagttcatacaggcgacggctctcttcctgcatgacatggacaatcacatcgcccaaatccacgacaatccagtcggcgctgttttcaccttctacgccgagcggtaacaggcccgctgcgcgagactcctgcacaacgtgatcagcaatggacataacatggcggctggacgtacccgtacagatgatcatgcagtcggtgatgctggatttgccctgaacgtctaaggcgatgatgtcctgacctttgaggtcatcaattttgtcgataacaaaatcctggagtgctttaccctgcaagttttccccctgggtgaatcaaatagataaaaatggtctgtcagtatacctgaaccagaggcgatttcgggacaattgtcgccgaatcggctttcgaaagtgggctatcatcccaccccgcgccgcagattgcatcgccatttttgtaaaacaatttctacaaagtcgtgtctggcggaaaaagtctggctgcggagaatatcagcctgcccggggctgtcaatggtcgttgcggcttacccgtaaaaaaacagaaaagtcatgcattctcgaccccgatggcacggctattgaggacgcgtagcgtcgcgaatttttggttgatatcaatggcgctccaacccccctggtcaacgcggaaatgccacatagactcggcaggcatgccaattaaacgagcaattaacagactcagtacgccctgatggctgacgactaaaatattctgatagtgctgatattcactaagccttgcgataaatcgttccacacgttgcgaaaatgcctgaaatccttcaccgttcgtggggatagcatgctgccagtcattgcaccacgcgctatagttttcggcatcttcttgcatgaggtcacgatgatgtcgcatctcccagtcgccaaaaaacatttcattgagttcagggatgatatgaacggggagctggcggtcactaagaaccagtcgcgcggtatgctgtgcccgttccagttcactgcataaaaccaggtcaaaggaaacatcatgtagcagcgtatgcagattttgcgcttgctcaataccgcgcgcggtcaggggggtgggcgcatgaccgctgtacagaccatcgacattcgcttgcgtttcaccatgacgaattaaccacagtcgcatcatgccctccgtaacgacaggtatcagcgatacaagccttgttggttaatgtaagtcagtaccggttccggtaataaatcctcacacgattcaccattttgcaaacgttcgcggatgatggtcgccgagatgttaaaccacggcgtttcagccagataaattttaccggcaggctgaaggtgaagatcttccgggttatgtgtcaaatgatcctccagccattgctggtattgcggttgcgccatttcaagtgggtaaccaggacgccgacagacgatcaaatgtgcattgtcgagtatcgtttcgtattcgtaccaggtcggaaaggtcagcaatgaatcctgaccaataataaacgccagcggcacgtccggtccttgctcctgccgccactctttcagtgtttgcgcagtgtaagagggggcattgcgctttagctcgcgttcatcaagggtaaacagtggcttgtcagctatcgccagttcaagcatgtgtttacgctgcgcgctgttcgcttccggctggggacgatgcggaggaacattattagggatgattgtgacccgcgtcagaccaatcaaattcgccagcgtttccacgggtttaagatgaccatagtgcaccggatcaaaggtgccgccaaacagagcctgtaaagatttcatatcaaccgtcgataaatacgtccgccaggggtttatggcacaacagaagagataacccttccagctcagcccacactgactgaccgtaatcttgtttgagggtgagttccgttcgtgtcaggagttgcacggcctgacgtaactgcggctggcttaagcgatttaacgcctcgctcatcatgcccctgcggttctgccatacccgatgcttatcaaacaacgcacgcagtggcgtatgggcagactggcgtttcaggttaaccagtaacaacagttcacgttgtaatgtgcgcaacaaaataaccggttcgctgccttccagacgcagctgctgaagaatatgcaacgcgcgcttactttttcccatcaacaaagcatcaacccaatgaaaaggggtgaaatgcgcggcatcattcaccgcctgttcaacgcgcggtaatgtcagtttgccgtccggccagagtagcgataaacgctccagtgcctgggccagcgccagcaggttaccttcataacagtagcagagcacctgatttgcagcgtcatccagttctaagttgagctgttttgcgcgcgcagcaacccagcggggaagctgagcctgctccggtgtctgacaggtcacctgcacgctgcgattcgcaagagcagtaaaccaggcggcattttcttgcgctttgcttaatttattaccgcggacgatcaacagcaggtcgtcatggagaagtccggtgagtgtgagaagttgttcattgatcgccgcattcggtccgttttcgggtaacaacagcaatagcgtttgtctactggcaaacagactcatagcctggcataacgaaaagatcgcattccagtcagtgttgggatcaatggaaaaagtgtggtgttcttcgaatccttgtgccgcagctacctgacgaacagcgtcctggctttcctgcaataacagaggatcgttaccaagtaaaagatacgccgcgcgcagcccttcattgagctgcgcgcggagttgttccgggtacaaccgaatcatcagttacccagcgtggtggagacgcgtgcaggcgttgccagagtatccgttgtggtcgacgtctgttcttcgtcggaacgaatatccgcagcacggatgcttggcagcttacgaatcagctgttcggcagcacggtcgtacatctcttttacgatcatgtcttgttcgttatctttcgctaacgccatttgcgggttatcgaagaacgaacggaagactttggcgctaatcgggtagatatcacggccggggatcaacacggtcgcattcaccgtcatgatcatctgatactctgctgtttgaccgttacggaataccgatgcggtatctttcgcgatgctcactttacccaaacgcagggatggaacgtccttacgcgtggtttctttatcaagcaactcgacaccattcagacgtaactggttacgcaccgcacggcttaatggcccgttcggatcgcctgagtccaggatcatgaccttcatagtggaaggaacctgcgtggtatcacgcagatgccagccacacccggcggtgattaacaccgccagagataacaacaatgttgccagatatcgcacgcttcctcccgcgcttagccaacgaccagattgaggagtttaccgggtacgtaaatcactttacgtacagtaacgccatcaagatattttgctaccagatgttcctggccagcacgttcgcgaacctgttcttccgttgcgtccaccggaacggtgatttttgcacggactttaccgttaacctgcaccacgaccagcgtggagtcttccaccatcgctttttcgtcagcaaccggccacggcgcgttgtcgatatcgccttcgcctttcagttcctgccacagcgtgaagcagatgtgcggggtgaacgggttaagcatacggactaccgccagcagcgcttcctgcatcagggcgcgatcctgctcgccatcggtcggtgctttcgccagtttgttcatcagctccataatcgccgcaattgcggtgttgaaggtctgacgacggccgatatcatcggttactttagcgatagttttatgcacatcgcgacgcagcgctttctgatcttcagtcagcgcatcgacgttcagtgccgcaacatcaccttttgctgtgtgctcgtacaccagtttccagacacgtttcaggaagcggttagccccttccacgccggattcctgccattcgagagtcatatcagccggagaagcaaacatcataaacagacgaacggtgtccgcgccgtaacgttcaaccatcacctgcgggtcgataccgttgttcttcgacttggacattttgctcatgccggtataaaccagttcatggcctgccgcatctttcgctttcacgatacggcctttctcgtcacgttcaacgatagcatcaaccggggaaacccagttacgttcgccgttttcaccaacatagtagaaggcatctgccagcaccataccctgacacagcaactgtttcgctggttcgtcagagttcaccatgcctgcatcacgcatcagtttgtggaagaagcggaagtagagcaggtgcataatggcgtgttcgataccaccaatgtaaatatccaccggcagccagtagttagccgctttggaatccagcataccttctttgtactccgggcaagtgtagcgcgcatagtaccaggaggactccataaaggtgtcgaaagtgtcggtttcacgcagtgctggcataccgttaacggtagtttttgcccattccggatctgctttaatcgggctggtaatgccgtccatcaccacatcttccggcaggatcaccggcagctggtcgtccggggtcggcattacggtaccgtcttccagcgtcaccatcggaatcggcgcgccccagtaacgctgacgagaaacaccccagtcgcgcaggcggtagttcactttacgctcgccaacgcccatcgcagtcagtttatcggcgatggcgttgaaggccgcttcatggtcaagaccattaaactcgccagagttgaacagcacgcctttttcagtcagggcttgctgagaaagatctggctcagagccgtcagctgccaggataaccggtttgatgttcaggccgtatttagaggcaaactcgtagtcgcgctggtcgtgacccggaactgccataactgcgcccgtgccgtattccatcaatacgaagtttgctgcccaaacgggaatttcttcgcccgttaatgggtgaactgctttaaagccagtatcgacgccttttttctccatcgtcgccatttcagcttcggcaactttggtgttacggcattcgtcaataaaggcggccagttcaggattattttccgccgctttctgtgccaacggatgacccgcagccaccgccaggtaggtacaacccatgaaggtgtccgggcgggtagtgtaaacggtcagcgtgttgtcatagtcgttaacgttgaaggtgatttccacgccttcggaacgaccgatccagttacgctgcattgttttaacggtgtctggccagtgatccagtttatccagatcgttgagcagctcgtcagcgtaagcagtgattttgataaaccactgcgggatctctttacgctcaactttggtatcgcagcgccagcagcagccgtcgataacttgttcgttcgccagtacggtctggtcgttcgggcaccagttgaccgcagaagtcttcttatataccaggccttttttatacagttcggtgaagaatttctgttcccaacggtagtattccggcgtacaggtcgccagctcgcggctccagtcataaccaaagcccagcattttgagctggtttttcatatacgcgatgttgtcgtacgtccacggtgctggcgcggtgttgtttttcaccgccgcgccttccgcaggcagaccaaatgcgtcccagccgattggctgcaggacgtttttgcccagcatgcgctggtagcgggcgatcacgtcaccgatggtgtagttgcgaacgtggcccatgtgtagtcgaccagaaggatagggaagcatagacaggcagtaatacttctctttgctctcgtcttcggttacttcaaatgtgcgcttctcatcccagtgaagctgtactttggattctatctcttccgggcggtattgctcttgcatggcagccagtggtcctgttttcaatacggctacaaatgtagcgttgatgtggtttttcagatccgcatagcatagcccaaacgcccgcgtcaaaacagcctttcgcgcacttgacgttgaaatgatgcccggattattcatacattaatttacagagtttgtgggcgtattagcaaagcaaggaacaaagaacgtctattattatagtcagttaacgacccgggagatgaaacgatgaacaaggttgctcaatattaccgtgaactggtcgcgtcactgagcgaacgcctgcgcaatggcgaacgtgatatcgacgcactggtggaacaggcgcgcgagcgcgtaataaaaacaggggagttaacgcgaaccgaggtcgatgagctgacgcgagctgtcagacgtgacctggaagagttcgccatgagctatgaagagagcctgaaagaagagtctgacagcgtctttatgcgggtgattaaagaaagcttgtggcaggagctggcagacatcaccgataaaacgcagcttgaatggcgagaagttttccaggacctcaatcatcacggggtttatcacagcggagaagtggtagggctgggaaatctggtctgcgagaaatgtcacttccatctcccgatctatacaccggaagtgctgacgctatgcccgaaatgtggtcatgatcagttccagagacgtccgttcgagccgtaatgaaatgagtggtgccggatggcgtgatgtcatccggcgagtgattaagcgtaaaatttcagacgatcagccagtaaatcaacaaagccctgacgatcaacatcgaccattacggtggcattcggtttattgccagtcagataataataatcaacaactgtcataccctgggtatatttcccttgtgtttccacgccaacccagcgctcaacagtggtaaacaactccggtttcaacagccaggcgatggtgcatgggtcatgcagtggtgcgccgacaaagccccatttttcgtctttatgatattcgaggaagaaatccagcagttcggcaacaatggttgaaacagggttgccaatcgcgcggaaacgctcagtgtcttcaacgtggatttgtgctttgtgagtaacatccagaccggccatcaccaccggaattcctgactggaagacaatttctgccgcttccgggtcaacgtaaatattaaattcagccgcaggcgtccagttaccaagccccattgcgccgcccataatcacgatacgggcaattttgctatgcagttccgggtggctattgagcagcaaggcaacgttagtttgcggtccggtagaaacaatggtgacaggttcctcactttcacacagcgttttcgccatcagctccaccgccgtacagttttgcggtgcgaacgtcggttccggtaatgccgggccgtcgagaccgctttcgccgtgcacgttgtccgcaataatcaaattacgcattaacggttttaccgcaccgcttgctaccggaatatcggtgcgattaagcaaggtcagcatacgcagaacattgcgtaaggttttttctggtgtctggtttccggcggaagacgtaattgctttgacatcaagctctggtgaggcgagggcgagaacgattgcgatagcgtcgtcatgacctgggtcgcaatctaacagaattggcagtgccattgttgctccttgttgtgtgtttctttgcgacaagggtaacgccgggatgtaacagatacgagggacgaaacgagaaagcgtgagatggcgcgcaattgagtatgcgcgccagagtgattaatgcaggatttttgcgaggaagtcttttgcgcggtccgattttggattatcgaagaaagcgcctttcggcgagtcttcgataattttaccctcgtccataaagatcacccgattcgccactttacgggcaaagcccatttcgtgggtcaccaccatcatcgtcattccttcgttcgccagttcgaccatcacgtccagcacttcgttgatcatctccggatccagcgccgacgttggttcgtcgaacagcatggcaataggatccatgcacaatgcgcgagcgatcgccacacgctgctgctgaccgccggaaagctgcgccggaaacttattggcatgtgcggaaagcccgacgcgctccagcaatttcaatgctttttcacgagccggcgctttattgcgtttaagcactttcacctgcgccagggtcaggttttcgataatcgacagatgggggaacagctcgaaatgctgaaacaccatcccgacgcgggaacgcagtttcgccagatcggttttcttgtcgttaaccacgatgccatcgacggtgatttcaccttgctgcaccggttcgaggccgttgacggttttaatcagcgttgatttgccggaaccagacgggccgcaaaccaccacaacttcgccttttttcacttcggttgagcagtcggtcagcacctgaaagtgaccataccattttgaaacatttttcagggtaatcattatgctgtccttcttttcaagtagctgaccaacaacgacgcgctaaggctaataacgaaataaacaaatccggcaaacaggatcatctcaacctgcgtaccatcacgctcaccaatggttgaggcggtacggaagaaatcggccagagataacacatacaccagtgaggtatcctgaaacagtacgatgccctgagtgagcaacagcggcaccatcgcgcggaacgcctgcggcagaataatcagtttcatcgactgccagtgagtcattcccaacgccagcgcggcgctcgactgaccacgagaaatactttgaataccagcacggataatctctgaatagtaggccgcttcaaacatcgaaaacgccaccattgccgaaattaaacggatatcatttttgggtgataatcccagcacgttttgcagaaaacccggtacgatcaggtaaaaccacagcaaaaccataactaaaggaatcgagcggaatacgttaacgtaggctttggcaaaccacgctacgggcgcaaagctggacaagcgcatcaccgccagcatggtgccccacaaaataccaatcaccactgccgtgacggtgattttcagcgtgatcaccagcccgtcgagcagatatggcagggaaggaacaatggaactccagtcaaactcgtacattatttgccccccatgttgccgggcaggcgaactttacgttcaaccagcgtcatcaccagcatgataaaagcgttaatcaatacatacgccagcgtaatggcggtaaacgactcccaggcgtgggccgagtaatcgagcaatttacccgcctgcgccgccatatccaccagaccgatagtcgaggcgatggcggagtttttcaccaggttcatcatctctgaggtcatcggcgggacgataacgcgataagcattaggcagcagtacgtagcggtaggcctgcggtagcgtcagacccatcgccagcgcggcatttttttgcccacgcggcagcgactgaatagcggcgcgtacctgttcgcaaacacgggcggcggtaaacagccccaggcagagcatggatgaaaggaaaaattgaatattagggtccagttccgccttaaaccacatgccgattttctctggcagcagctccgggatcaccagataccaggtaaagaattgcacaatcaacggcacgttgcggaacagttcgacatacaacgtacccagaccggagagaaaacggtttggaacggtacgtaaaatgccgaaaaatgaaccgacgaggaaagcgataatccaggcgcagatcgacaaagcgatcgtcacctgaaagccactccagatccaaccaagataggtggtgttgccgaacggggcttgttgtaaaaaaataccccagttccagtctatagacataaatctactccagaaaaaagagggtagcagcgttaactgctaccctcgaagattgttacccagcgtattgcggttttctggcccgatggggaacgaccaccaggcgtatagtctgtccgtgctacgtaacaatcgagagggctggaatttccgcccctggttcttgtaattagttcagtgccttgtcattcggttctttgaacagtgctttcatttcgtctgacagttcgaaattcatgttcaggtttttcggcggaattggatttttgaaccacttatcaaaccatttttccgcttcaccggaggtctgcacctgagcgatggtatcatccatcagctttttgaactgcggatcgtctttacgcaacatgcaaccataggcttcctgagactgcggcttgccgacgatttcccagttgtctggtttcttcgctttcgcacgttcaccggccagcagagcatcatccatcataaaggcaacggcacgaccgctttccagggtacggaaagagtcaccgtgatctttggcgctgatgatgcgcatattcattttttgctcttcattcagtttgttgagcaaaacttcagaggtggtgccggaagtgacgactacggctttgcctttcaggtcggcaaaatctttgatatcaccgccctttttggtcagcaggcgcgtaccgaccacgaaaatagtgttagagaaagccgcctgtttttggcgttcggcattgttggtggtagaaccgcattcaaaatcgaaagtgccgttttgcagcagtggaatacggttttgtgaggtgatcggaatcaatttcacctgtaagtctggtttgttgagtttctttttcactgcttcaacaatggcgttggagtaatcctgcgagtagcccaccactttttgctgattgtcgtaataagagaaaggtactgaagattcacggtgaccgacgacaatcacgccgtttttggcgattttgtccagcgtgctgcctgctgccggggcggcgtcatctgcctgtgccagtcctgcggaaagcgccagggccaggattgctgtggcaggtttacgtaattgcatatccaactcctttatcttctgcgttaaaaacgcatggatacccgttgtgagtgtttgtgttgttatcatctgcgactttattgtgcagtgttgtgtttgttaggtaacatttagtttggataaatgtaaagatattgcttttttattgtttatttttgcgaggtgcgccgcaccattccgaagcaaaattcttaaaccgcacctttttggtgctaccgctgatttgtggtggtgcaacccggttgcgttgcggctgatttcattgcttacacagtaaataaagcaacttacatgccaaaaaatacttaggggtgaattaattacgattgtaatttcagtttgaaaaagtcatgtttcagacagtgttaacttttcggtgtgggacgtttgccgggatgataactacactcgggaaaatgctttttactagtcttttcaaggaagaatcaccttatgtctgcatcttcggttaagccgttaaatgttcaattacccgcaataaccctgatcctttttgcgctctgtgttgggatattttgttacctcgcacaatggatgagttatgaagaagtcgatcaatccgcactcatccatctcggcgctaacgttgcttctctcacgttgtcggatgaatcctggcgcttattgagcagtgtttttctgcacagtagtttttcccatttgctgatgaatatgtttgcactcctggtggtggggacagtggcggaacggatactggggaaatggcgactcctgattatctggttattctccggcatctttggtgggctgatcagcgcctgttatgcgttacgcgaaagtgagcagatagtcatcagcgttggggcatccggggcaattatgggaatagcgggcgctgcgatagcaacacagcttgcttcaggtgcgggcacacaccataaaaaccagcggcgagtatttcctctgttgggtatggtggcgctgacactgttgtatggtacccggcaagcaggaatagataacgcttgccacattggcggcctgattgcggggggcgcgttgggttggctgagcgcgcgtttagttgggcaaaaccgattcgttacggaaggcgggattattgttgcggtcactcttcttctgaccggggctatctggcttgtgcagcagcagattgatgaatcagttttacaggtcaggcaaagcctgcgtgaagcgttttatccgcaggagattgaacaagagcgacgacaaaaaaagcagcagttagtggaggagcgcaacgccctcacggaaacattatccgctccggtaagtcgtgagcaggccagtggtgatttactcgctgagattgccgatatccatgatatggcgatcagtcgggatggtaatacgttgtatgccgcaattgaaaacacgaacagcattgttgttttcgacctcggacaaaagaaaatcctgcatacctttacagcgcccatagcgaaagaaaagtcagtcaaacattgtggtggctgtaaagatcagggcgtcagatcgctggcattaagcctggatgaaaagttgatttatgcgacttcatttgaagcgaatgcgttatcggtcattaacgtggcgacgggggagattattcagtcgattaccaccggcgcacatcctgacagctttatcctctcgcgtgatggcacaaaagcctgggtgatgaatcgcaccagtaatagtgtgtcagcgattgatctggtggcttatcagcatgtggcggatatcccgctggagaaatacgacgggacggggatgagcggtaaaccaggcgcctgggttatggcactttccccggatgaaaaaacattactggttccgggagcaggcagaggtaacatcgtgcggatcaataccatcacgcatcagaaagaagactttcccgcaggtaatgcgcgtggtgtcgtttctgcgatgggattccgaccaaaaaatggtgagattatttttgccgatagccaggggatttcacgtataagagctgaggatcaacaagccagcattatgacgcaatggtgtagcaggagcgtttattccgttgagggtattagcccggacggtcagtatttagcgttggtgtcatatggcctgcaaggttatgtcatcctgctcaatattaatgccgggcagattattggcgtttatcccgccagctacgtgaatcatcttcgtttttcagcggatgatagaaagatatttgttatggcgaagaacaggttaatccaaatggacaggacgcgctcgcttgatccgcaggcaattattcggcatccccaatatggcgatgtggcttgtatccctgaaccgtaagaaaaaagggcatgataatcatgccccagagcgtgttgaaaaagtacgctttatcctacaaaatcgcgaaaattcaacatattgtaaaaatcgcgtaggcctgataagcgtcgcgcatcaggcacattaacgtttgcgagcacgcagactcatcagtacagcggcaaaaccaaacagcgccgtcagcacccacagcggccagttgccggttcgtgcgtacggtgtgagtccggtggttggtgtcacgttagtggtcaacacctcgcgggtgaactgcgggatcatcgcctgaatctcaccctgcgggccaatcaccgccgtaatgccgttgttggtgctgcgcaacagtgggcgcgccagctccagcgcacgcattcgcgccatctggaagtgctgccatggaccaatagacttaccaaaccacgcatcgttggagatggtcagcagatagtcggtatccgggcggaagttatcgcgcacttgctcgccgagaatgatttcgtagcaaatggccgcagtaagttgaatgccattcaacgacagcggtggctgaatatatggtccgcggctgaatgacgacatcggcaaatcaaagaacggtgctaacggacgcagtatcgactccagtgggacaaactcgccaaacggcaccagatggtttttgttatagcgatcggctgattcatagctgtacggtgcgcctttacccagtgtgatgatggtgttgtaggtatcgtagcggttctgtttattgagacgcgcgtcgacaatcccggtgaccagcgagctacctttatcgcgcaactcaccgtccagagctttaaggaacggttgctgattaatttccagatcggttatcgccgactccggccagataatcagcgatgatttgcccatcagcggtgccgttgcgttgtagtaaatcttcagcgtattaagaagctggccttcgtcccatttcagcgattgcggaatatcgccctgaaccatcgaaacctgaatggttttctccggttgcggggtaaaccactggatgtaacgcagcgggaagggaagggcaaacagcacgacggtcaccaccagcggacgccagttgcgtttgaccaacgccagtgccagcaggccactaaccatcatcagcaggaagttaatggcttccacgcccattatcggtgccagctcttttaacgggccatcaatctggctatagccgaactgtaaccacgggaagccagtcagcacccaaccgcgcagaaactcggtcacttgccagagagcaggggcggcaatcgccacgcgcagccaggtggttttcggccacagacgcgacagcacgccagcaaacagtccggtatacagcgacaaatacgccgccagcagtaccaccaggaagatgttaaccgggccaggcattccgccaaaggtcgcgatgctgacatagacccagttaataccgctgccaaagaggccaaatccccagcaaaagccaatagcggcagactggagtggacggcggttaaaggtcaacgcctgaagccccatcagcgaaataatcgccgcaggccagacgtcgtaaggagagaaggccagcgttccgcaggcaccgaataataacgccagcagcaggcgaatgcgctggcgttcaattaatgaggcaaaagccatgtagttatctatccagtttcggttttattcatccagcttcggctggggtgagtcatccgggattttgacatgaacctgaataatacgccgactgtcggccatcgccactttgaactggtaaccgtcgatgtcgatggtttcgccacgcgccggaagatgcccaaatgcctgcatcaccagaccaccgatagtgtcaacctcttcatcgctaaagtgggtgccgaacgcttcgttgaagtcttcaatagaagccagtgcgcgcacggtccaggtatgacgactcagctgacggaagtcgatatcatcttcttcgtcatactcgtcttcaatctcaccaacaatcagttccaggatgtcttcaatggtcaccagaccggaaaccccaccgaattcgtcaatgacgatcgccatgtggtaacgctgagagcgaaactctttcagcatccggtctacgcgcttactttcaggaacgacaaccgcctgacgtaacactttgtccatgctgaaggcttcagcatcgctgcgcataaacggcagcaagtctttcgccatcagaatcccttcaatgtgatctttgtcttcgctaatcaccgggaaacgtgagtgggcggactcaatgatgacatcaaggcattcgtccagcgtctggttgcgtttcagggtaatcatctgggagcgggggatcatgatgtcgcgaacgcgttggtctgcgatgtccatcaccccttcgagcatatcgcgcgtatcttcgtcgataaggtcgttctgcccggaatcacggatcagcgccagcagttcgtcacggtttttcggttcaccgtggaaaagttggctgagtaacagggagaaaaatcccttcttgttgcttatcgtgtcactactgtgtgaattgtcgtcgctcatggcgtcgtatgggttctcatgttagttaatcaaaacgccgtcgttaatcaccaacggcggggacgtctgccagtcaaatgcctggcaaattattctttctcggcaatgtacggatcctcatagcccagagcaagcataatctctgtttcgatggcttccatttcttctgcttcgtcatcttcgatgtgatcgtaacctaacaaatgcagactgccgtgcaccaccatatgcgcccagtgcgcctccagtggtttgccttgctcctgagcttccttctcaaccacctgacggcagataatcagatcgcccagtagcgacatttccatgccaggcggtacttcaaacgggaaggagagcacgttggtcggcttatccttaccgcgataggtcagattcagacagtggctttcggcggtatcgaccacgcgaatagtcacttccgattcttcctgaaactgcgggatcaccgcattcagccatgtctgaaactggctctcttccggtaacccggaattatcttcacatgccagttgtaaatcgaggatcacctgactcatttttgttcctgttcttcgcgcttgcgttctgctgccagcgccgctttacgtttttgttcggcttcttcccaggcttcataggcgttaacgatacgcgccaccaccgggtgacgaaccacgtcttcgctgtggaagaagttaaagctgatctcttcgacatcggccagcacttcgatggcatgacgcaaaccagacttggtattacgcggcaggtcgatctgtgtgacgtcgccggtgataaccgcttttgagttaaaaccgatacgggtcaggaacatcttcatctgttcgatggtggtgttctggctttcatcaagaatgataaacgcgtcgttcagcgtacgaccacgcatataggccagcggtgcgacttcaataacgttgcgctcaatcagtttctcgactttctcaaagcccagcatttcaaacagcgcgtcgtacagcgggcgcagatacgggtctactttctggcttaaatcgccaggcaggaagcccagtttctcaccggcttcgaccgccggacgagtcagcagaatacggcgaatttcctgacgctccagggcatcaactgccgcagccactgccaggtaggttttacccgtacccgccgggccaacgccgaaggtaatgtcatggtcgagaatattggcgatgtactgcgcctggtttggcgtgcgcggcttaattacgccgcgtttggtcttgatattgaccgctttgccgtactccggcacgctctccgcgctttgctccagtacccgcgcttctttaatcgcaaggtggatctgttccggttcgatatcctgaatctgaccacgcatcggggcagtatcgacatacaggctacgcagaatgtctgccgcagcggtgacgcaaatcggacggccggtcagtttaaagtggttatcgcggcgattgatctcgatgccgagacggcgttcgagctgcttgatgttgtcatcaaacgggccgcacaggctcaacagacgcgcattgtctgctggctccagggtgatttcgcgagtgtctatgttcaaaccgttcctcttatctgtatgccgccggaagctgaacattcaccggcctataaggaaattattcacgccacaggaaaaaggcgcaagcattgcgataaagatggggataaagagagaaaaaacaaggcccaccggaacggcgggcctgagaattacggctgataataacccacgccaaggtcgttttctttgcgggtacgggcaatcaccgattccggtgtttctgccacgcgcagacccatttcatcttcagttcgcaccactttaccgcgcagagagttcgggtagacgtcggtaatttctacatcgacgaatttaccgatcatatccggcgtgccctcgaagttaaccacgcggttattttcagtgcgaccggaaagctccatgatgctcttacgtgaagtcccttctaccagaatgcgctgggtggtgccgagcatccggcggctccatgccatcgcttgctgattaatgcgctcttgcagaatatacagacgctgcttcttctcttcttccggaacatcatcaaccatatcggcggctggtgtacccggacgtgcagagaagataaagctgtagctcatgtcgaaattgacgtcggcaatcagcttcatcgttttctcgaagtcttcggtggtttcgccagggaagccaacgatgaagtcagaactgatctgaatatccggacgcgccgcacgcagtttacggatgatcgctttgtactccagcgccgtgtgagtacggcccatcaggttcagaatgcgatcggaaccgctctgtaccggcaggtgcaggaagctcaccagctccggcgtgtcgcgatacacttcgatgatatcgtcggtgaattcgatcggatggctggtggtaaagcgaatacgatcgatcccgtcgatggcggcaaccagacgcagcagatcggcaaacgttccggtggtgccgtcgtagttctcaccacgccaggcattcacattctgaccgagcaggttgacttcacgcacgccctgagccgcaagctgggcgatctcaaacagaatatcgtcggacggacggcttacctcttcaccacgggtgtaaggcaccacgcagtaggtgcaatatttattgcagccttccatgatggagacaaacgcggtcggcccttcggcgcgcggttctggcagacggtcaaacttctcgatttccgggaagctgatatctacaaccgggctgcggtcgccgcgcacggagttgatcatctccggcaggcggtgcagcgtttgcggcccaaaaataatatcgacatagtgggcgcgctggcgaatgtgctcgccttcttgcgatgccacgcagccgccgacgccgataatcaggtctggattcttctcttttaacagtttccagcgacccaactgatggaagactttttcctgagccttctcgcggattgagcaggtgttcagcagcagcacatccgcttcttccgccacgtcggtcagttgatagccgtgggtggcatccagcagatcggccatcttcgatgaatcgtactcgttcatctgacagccccaggttttaatatggagttttttggtcatcgacttgctcttgcgaaatagtagccaggaatgcagggcgcatagtgtaatgctttgctgccgttgtgaccagtatgagcgttatcagcccttgggggtaaaaatcctgtaaacttaaagcatattgctaacaggatgattgaccatgacaaatcaaccaacggaaattgccattgtcggcggaggaatggtcggcggcgcactggcgctgggactggctcagcacggattttcggtaatggttatcgaacatgcccaacctgcaccgtttgtcgctgacagccagccggacgtgcggatctcggcgattagtgcggcttcggtatcattgcttaaagggttaggggtctgggatgcagtacaggctatgcgttgccatccttaccgcagactggaaacgtgggagtgggaaacggcgcatgtggtgtttgacgccgctgaacttaagctaccgttgcttggctacatggtggaaaacactgtcctgcaacaggcgttgtggcaggcgctggaagcgcatccgaaagtaacgttacgtgtgccaacctcgctgattgcactgcatcgccataatgatcttcaggagctggaactgaagggcggtgaaacgatcctcgcgaagctggtgattggtgccgacggcgcaaattcgcaggtgcgacagatggcgggaattggcgttcatgcctggcagtatgcgcagtcgtgtatgttgattagcgtacagtgtgagaacgatcccggcgacagcacctggcagcaatttaccccggacggaccgcgtgcgtttctgccgttgtttgataactgggcatcgctggtgtggtatgactctccggcgcgcattcgccagttgcagaatatgaatatggcgcagctacaggcggaaatcgcgaagcatttcccgtcgcgtctgggttacgtgacaccgcttgccgctggtgcgtttccgctgatacgtcgccatgcgttgcagtatgtgcaaccagggcttgctctggtgggcgatgccgcgcataccatccatccgctggcgggacagggagtgaatcttggttatcgtgatgtcgatgccctgattgacgttctggtgaacgcccgcagctacggcgaagcgtgggccagttatcctgtgctcaagcgttaccagatgcggcgtatggcggataacttcatgatgcaaagtggtatggatctgttttatgccggattcagcaataatctgccaccgctgcgttttgtgcgtaatcttggtttgatggcggcggagcgtgctggcgtgttgaaacgtaaggcgctgaaatatgcgttagggttgtagcctcacaacattgctggatgcatgccaaccgtaggtcggataagacgcggcagcgtcgcatccgactttgaaggataagacgagtcaacatcgcattcggcattgaatatacgcagaaaagcaaaaagctcgccgaagcgagcttttttaatgtggctggggtacgaggattcgaacctcggaatgccggaatcagaatccggtgccttaccgcttggcgataccccaactgggtgcacttacaaggtaagcgtcttgaataaattggctggggtacgaggattcgaacctcggaatgccggaatcagaatccggtgccttaccgcttggcgataccccaacaaattggtttttgaatttgccgaacatattcgacacattcagaatttggtggctacgacgggattcgaacctgtgaccccatcattatgagtgatgtgctctaaccaactgagctacgtagccagattgtttcttcgatggctggggtacctggattcgaaccagggaatgccggtatcaaaaaccggtgccttaccgcttggcgataccccaataaccgggcggtgaaccgcttattcgaagaatatggctggggtacctggattcgaaccagggaatgccggtatcaaaaaccggtgccttaccgcttggcgataccccatccgtacaacgctttctggtgaatggtgcgggaggcgagacttgaactcgcacaccttgcggcgccagaacctaaatctggtgcgtctaccaatttcgccactcccgcaaaaaaaagatggtggctacgactggattcgaacctgtgaccccatcattatgagtgatgtgctctaaccaactgagctacgtagccatcttttttttcgcgataccttatcggcgttgcggggcgcattatgcgtatagagccttgcagcgtcaacctctttttcaaggaaaattgctcgaaagtgactgtttggttaggttgcgaacagcatggcgctatattcgtcaattattgtttactttgtgttttttccccaccctacagccattcttttgtcatacaggatgaaattcggaattcaacaatagtggtgggaaattaatctatgaaatactggcctacagtaatgagttgtcaaacatcgatgtggcaaacccggaacatttccttactgcatatcagaatcaacaagcgccccagtaactgaaattgccccggatttctccggggcaatattacacgtcttatttatatgccgactggtgaacgccaaccgcgcgaccagacggatcgtccattttcttgaacgcttcatcccactcaatcgctttagcggaagaacaagcgacggaaggaccgcccggcacgcactcagcggcgctcggaagcgggaacaattcttcaaagatctcccggtacagatacgcttcttttgaggtcggcgtgttgtacgggaagcggaagcgggcagtttccagctgttgatcagaaacctgctgcgctgccacttctttcagggtgtcgatccaactgtaaccgacgccatcggagaactgctctttttgccgccaggccacgcttgcaggcagatacgcttcaaaacattcacgcaggatgtgtttttccattttgccgttaccgcacattttatcctgtgggttaatgcgcatcgccacatcaaggaattttttgtcgaggaacggaacgcgtgcttccacgccccaggctgacatcgctttgttggcacgcgcgcagtcatacatatgcagggccagcagtttacgcaccgtctcttcatgcaactctttagcgttcggcgctttgtggaagtatagataaccgccaaacacttcgtcagaaccttcaccggacagcaccattttaatgcccatcgccttgatcttacgcgacattaaatacatcggtgttgaagcgcgaatagtggtcacatcataagtttcgatgtggtaaatcacgtcgcggatggcatccagaccttcctgtacagtgaagtgaatttcgtgatgcaccgtgcccagatggtttgccacttcctgggctgctttcagatccggtgagcccggcagacctacagcaaaggagtgcaactgcggccaccaggcttcagagcgttcctgatcttccacgcgacgggcggcgtatttcttggtgatagcggaaataattgaggaatccagaccaccagaaagcagcacaccgtaaggcacatcagacatcagatggcttttaacggaatcttccagtgcctgacgcagctcgtttttgtcggtcacgttatctttcaccgcatcgtagtcgaaccagtcgcgatgataataagaacggatttcgccgtcctgactccacaaatagctccccgccggaaactctttaatcgtgcggcaaactggcacgagggctttcatttctgaggccacatacagctgaccgtgttcgtcatagcccatatacagtgggatgatccccagatggtcgcgaccaatcagatatgcatctttttcgctgtcgtacagggcaaaggcaaacatgccctgcaagtcgtcgagaaattccggcactttttcctgatacagcgcgaggatcacttcacagtcagacccggtctggaactggtaacgatcgccatattcagcgcgcaatgcctggtggttgtagatttcaccgtttactgccagcacatgagttttttgttggttgtagagaggttgcgcccccgcgttaacgtcaacaattgacagacgttcgtgggcgaggatggcgttatcgctggcataaataccggaccagtccgggccacgatgacgcatcaggcgtgacagctcgagtgctttcttacgcagctcaactgcgtctgttttgatatcgaatacgccaaaaattgaacacataaccttctccgttaacctggtgtttactgcgtgttgtgtttacttgttaaaaaaatgccgcaaagcagcacggtgcgcaagcgatttggcagtggaaaaataaaaaacgtaatggcgattgctgattgatgaaaaaggggagggcttttgggtatatttattgatggatcgataatttttgacgggttttattgaatggggtgattttaatgatggggaaaaataagaaaccacgccctgaggcgtggttgctattcagataacgtcgatttcagcgaccgatgggtaaatccaacttgggcggaacggcatactgtcgatatcgtcgagtgacgaaacaccagaaagcaccagaatcgtctccagaccggcctggaagcccgccagaatatcggtacgcaagttatcgccgacaatcaccgtttcttccgaatgcgcctgcattttgtttaatgccgcgcggatgatccacggactcggctttccaacatagaacggtttgcgcccggagattttctcgatccctgcacacaacgcgccacaggcgggataaaaaccgcgcccgtgggtgtccgggttggtggcgataaagcgtgcaccgttagcgacgaaataggctgctttatgcatcatgtcccagttgtaggaacgcgtttcgccaacaatcacaaaatcagggttcacatcggtaatagtgaaaccggctttgtacagttcatgaatcagtgcgccttcgcccaccacatacgctttcttgccttcctggcgacgcaggaaatcggcggtcgccatcgcggaggtataaaacacgctatccggtacatcgacaccagcggtggcaaagcggttcgccagatcttgcccggtctgcgaaggatagttggtcagcaacaccagcggcaggcctttatccataatcccgtgcaaaaattccgctgcacccggtacggcgacgttatcgtgcatcagcacgccgtcgatatcgcaaattacatttttaatggtcatggactacccagaatattgacaacaataagcgccactataaaagcacattaattttccagcaaatgctggagcaaaataccgttgagcatggcgcgttttaccagcgcaaaagcgccgattgccgagcggtgatccaactcagaacgtaccaccggtagattagtacgaaacgccttcagcgcctgggtattaatgcagctttcaatagcagggagcagcactttatcggcttcggtgatttctccagcaataacaattttttgcggattaaataagttgatagcaatggcgatggttttacccagatgacgaccgacatattcaatcacttccgaggccaggctatcgcctttgttcgcggctttgcagatagttttgatggtgcagtcgtccagtggcacacggctctggtagccctgctttaacagattcaacacccgttgttcaatggcagcattggcggcgatagtttccagacagccaaagttgccgcagtggcagcgttcacccagcggttcgacctgaatatggccaatttcaccgacgttgccgttgcgcccgataaaaattcgcccgttagagataatcccggccccggttccgcgatggacacgcaccagaatggagtcttcgcaatcctgacttgcaccgaagtagtgctctgccagcgccagactgcggatatcgtggccgacaaaacaggtcactttaaaacgctcttccagtgcttcaaccagcccccagttttctacctgaatatgcggcatgtaatgaattttgccgctgtccgggtctacaagccctggcaggatcaccgaaatcgcgatcagctcgcgtagcttgcgctggtagctatcaataaactgagcaatggcattcagcagggcatgttccagcgtctgctgggtacgttccggcagcgggtaatgttcttctgccagcactttgctgctgagatcaaacaaggtgatggtggcgtcgtgacgaccaagccgtacgccgattgcgtggaaattgcgggtttcggtgacgatggagatagcgcggcggcccccggtggaggcctgctgatcaacttctttgatcagcccgcgttcgataagctgacgcgtaattttggttacgctggcgggggcaagctgactttgctcggcaatctgaatccgcgagattggcccgtactggtcaatcaggcgataaaccgccgcgctgttaagctgttttacgagatcaacattacctatctgagcttgtccgcctggtgtcatactttctcttattgagttacgacctcgttaccgttaacgatggtcctggtgattttaaaatcaggtgtgaatgcagtcaggttggctactttacctgcggcgagcgtgccgagacgtttctcaacgctaatcgcacgtgccggatagagcgtcgccatacgcagcacttcatccagtgcgataccacaatgttcgaccagattacgcacgccttcaatcatggttaaggatgaaccgcttaacgtaccgttctcatccacacaaagtccattacggtagtatattgttttacccgcaaaaatgaactgttcaatgttggcacctgctggcgcggtggcatcggtaaccagacacaatttgtcgcctttcagacgtttagcgttacgaatgttggcgtaatcaacatgcaggccatcagcgataataccgcaataaatgtcagcttcgtcgaggatcgcgcccgccaggcccggttcacgaccggtaatatacggcatcgcgttgtacagatgggtggcaaaggtaatccccgcgcggaaaccggctttcgcttctttcaacgtcgcgttggagtgaccagcagaaaccacaatcccggcatttgccagtttgctgatgacttccgttggaaccatttccggtgccagagtcactttggtaatcacgtcggcgttctcacacaggaaatcgaccagcgcggcatcaggcttacgcacaaaattcggattatgggtgcctttttttaccagattcagccacggaccttccagatgcagacctaacgcctggttcggatgttttgccaggtactcgcgcataacgcgcacgccctgtttcatcagctcatcgctggtggtgataagcgtcggcagatagttagtacagcctgatttctcattggctttctgcatgatttccagcgtttccacgctgaccgcttcagcggtgtcgttaaactgtacgccgccgcagccgtttaactgcacatcgataaaaccgggggagagaatggccccgttcagtgaacgttgttcgatctctggcggcagttccgctaccggacagacgcttttaatcaggccatcagcgataacaaccgcgtggtcatcaagaaattcgtggccggtaaagatccggccctgggttaatgcatacattctgacccccgattttaaaaaataatgccctgagcaaggagctagggcagggataacaattacagacccttgatattttctgcttctaattcattgaaatatcttaaagtcttaactttcagctccatggtggaaggttcatcgcacaccatgatcgcttttggatgcagttgcagacaactgatggtccacatgtggttcacgcaaccttcaacggcggcctgcagtgccagtgctttctgactacccagcaccagaatcatcacttcttcggcatccagcaatgtaccaacaccgacagtcagggcatattttggcacctgattaacatcgttatcaaagaaacgagagttcgcgacgcgagtgtcatgagtcagggttttgatacgagtacgagaagccagagaagacgccggttcgttaaatgcaatatgaccgtcgttacctacaccgcccataaacagatgaatttttccgtaagaacggattttttcttcatactggcggcattcggcgtcgatatccggggcgttgccgttgagaaggttgatattttctgctggaatatcaacgtgatcgaagaaattacggtgcataaagctgtagtagctttccggatgctctttcggcagaccgacatattcgtccatgttgaaggtgacaacgtgcttaaagctgacctggcctgctttatgcatttcgactaacgctttataggtggtcatcggcgtgccgccagtcggcaggcccagtacaaacggacgatcggcagtcggtttgaacgcattgatacgattgacgatatggcgagcagcccatttgccgacctgttcagcggtagtcagggggatcagtctcattattcacctcaataagtaaaatgtaagccgttggcggattaggcatctttaagcgtaacctggatttgcgcagacaggcgtcaatccgacctgattttttgaatgataaaataagttttctggtttagccagtaaaagggagtgatgataacgatatttggtgacaaaactcacaaaagacacgcgtttaatttgcgatacgaattaaattttcacacactctgtagcagatgatctaacaatctgattacagaacatcggcagtacaatttgcagcaaaataaaaatacggctttaaacgagccaaatagggttctcgtagggggaataagatgaatattttaggttttttccagcgactcggtagggcgttacagctccctatcgcggtgctgccggtggcggcgctgttgctgcgattcggtcagccagatttacttaacgttgcgtttattgcccaggcgggcggtgcgatttttgataacctcgcattaatcttcgccatcggcgtggcatccagctggtcgaaagacagcgcaggtgcggcggcattggcgggtgcggtaggttactttgtgttaaccaaagcgatggtgaccatcaacccagaaattaacatgggtgtactggcgggtatcattaccggtctggttggtggcgcagcctataaccgttggtccgatattaaactgccggacttcctgagcttcttcggcggcaaacgctttgtgccgatcgccaccggcttcttctgtctggtgctggcggccatttttggttacgtctggccgccggtacagcacgctatccatgcaggcggcgagtggatcgtttctgcgggcgcgctgggttccggtatctttggtttcatcaaccgtctgctgatcccaaccggtctgcatcaggtgctgaacaccatcgcctggttccagattggtgaattcaccaacgcggcgggaacggttttccacggtgatatcaaccgcttctatgccggtgacggcaccgcggggatgttcatgtccggcttcttcccgattatgatgttcggtctgccgggtgcggcgctggcgatgtacttcgcagcaccgaaagagcgtcgtccgatggttggcgggatgctgctttctgttgctgttactgcgttcctgaccggtgtgactgagccgctggaattcctgttcatgttccttgcaccgctgctgtacctcctgcacgcactgctgaccggtatcagcctgtttgtggcaacgttgctgggtatccatgccggcttctctttctctgcgggggctatcgactacgcgttgatgtataatctgccggccgccagccagaacgtctggatgctgctggtgatgggggttgtcttcttcgctatctacttcgtggtgttcagtttggttatccgcatgttcaacctgaaaacgccgggtcgtgaagataaagaagacgagatcgttactgaagaggctaacagcaatactgaagaaggtctcaatcaactggcaaccaactatattgctgcggttggcggtactgacaacctgaaagccattgatgcctgtattactcgtctgcgccttaccgtggttgactcagctcgcgtcaacgatgcgatgtgtaaacgtctgggtgcttctggggtagtgaaactgaacaaacagactattcaggtgattgttggcgcgaaagcagaatccatcggcgatgcgatgaagaaagtcgttgcccgtggtccggtagccgctgcgtcagctgaagcaactccggcaactgccgctcctgtagcaaaaccgcaggctgtaccaaacgcggtatctatcgcggagctggtatccccgattaccggggatgttgtggcactggatcaggttcctgacgaagcattcgccagcaaagcggtgggtgacggtgtggcggtgaaaccgacagataaaatcgtcgtatcaccagccgcaggaacaatcgtgaaaatcttcaacaccaaccacgcattctgtctggaaaccgaaaaaggcgcggagatcgtcgtccatatgggtatcgacaccgtagcgctggaaggtaaaggctttaaacgtctggtggaagagggcgcgcaggtaagcgcagggcaaccgattctggaaatggatctggattacctgaacgctaacgctcgctcgatgattagcccggtggtttgcagcaatatcgacgatttcagcggccttatcattaaagctcagggccatgttgtggcgggtcaaacaccgctgtatgaaatcaaaaagtaatcttctttatgcctgatgcgacgcttgagcgtcgcatccaacaatgacaagcggtggagatcttctctgccgctttttttttcatcaatcattcccataatctcagtgagattttcgattttcactaactaacagttgtcagcctgtcccgcttataagatcatacgccgttatacgttgtttacgctttgaggaatccacgatgagtgaggcagaagcccgcccgactaactttattcgtcagatcatcgatgaagatctggccagtggtaagcacaccacagtacacacccgtttcccgccggagccgaatggctatctgcatattggccatgcgaaatctatctgcctgaacttcgggatcgcccaggactataaaggccagtgcaacctgcgtttcgacgacactaacccggtaaaagaagatatcgagtatgtcgattcgatcaaaaacgacgtagagtggttaggttttcactggtctggtaacgtccgttactcctccgattattttgatcagctccacgcctatgcgatcgaactgatcaataaaggcctggcgtacgttgatgaactgacgccggaacagatccgcgaataccgcggcaccttgacgcagccgggtaaaaacagcccgtaccgcgatcgcagcgttgaagagaacctggcgctgttcgagaaaatgcgtaccggcggttttgaagaaggtaaagcctgcctgcgtgcgaaaatcgacatggcttcgccgtttatcgtgatgcgcgatccggtgctgtaccgcattaagtttgctgaacaccaccagactggcaacaagtggtgcatctacccgatgtacgacttcacccactgcatcagcgatgcgctggaaggtattacgcactctctgtgtacgcttgagttccaggacaaccgccgtctgtacgactgggtactggacaacatcaccattcctgttcacccgcgccagtacgaattctcgcgcctgaatctggaatacactgtgatgtccaagcgtaagctgaacctgctggtgaccgataagcacgttgaaggctgggatgacccgcgtatgccgaccatttctggtctgcgtcgtcgtggttacactgcggcttctattcgtgagttctgcaaacgcattggtgtgaccaagcaggacaacaccattgagatggcgtcactggaatcctgcatccgtgaagatctcaacgaaaatgcgccgcgcgcaatggcggttatcgatccggtgaaactggttatcgaaaactaccagggcgaaggcgaaatggttaccatgccgaaccatccgaataaaccggaaatgggcagccgccaggtgccatttagcggtgagatttggatcgatcgtgccgatttccgcgaagaagctaacaagcagtacaaacgtctggtgctgggtaaagaagtgcgtctgcgtaatgcttacgtcattaaggcagaacgcgtcgagaaagatgccgaaggcaatatcaccaccatcttctgtacttatgacgccgacaccttaagcaaagatccggcagatggtcgtaaagtcaaaggtgttattcactgggtgagcgcggcacatgcgctgccggttgaaatccgtttgtatgaccgtctgttcagcgtgccgaaccctggtgctgcggatgatttcctgtcggtgattaacccggaatcgctggtgatcaaacagggctttgctgaaccgtcgctgaaagatgcggttgcgggtaaagcattccagtttgagcgtgaaggttacttctgcctcgacagccgccattctacggcggaaaaaccggtatttaaccgcaccgttgggctgcgtgatacctgggcgaaagtaggcgagtaagtttacgttgtcggatagagcgtttacgccgcatccggcaagaaatatgcaaattatcccaaacgccgcgctctgcggcgtttttttctgcttttcttcgcgaattaattccgcttcgcaatttatccataaaacaaatttaaaatcacaaaccataattaaataaaatgtaaccgttttcatcttgctggaaattcacgcttttattcttctgcaagcctttcaactgcaaacttaagccttgtaacaaaaatcatcaaaatatgtgcggttgctcatgttcttacattctggttacagaaagagattgataattcgcgtcgcgaaaaatagtctgttcctgtagtcagcgagacttttctcaacgctacttttttaatttttatttttttcgctgttcacctttggtgcagcaatttatacgtcaaagaggattaacccatgcgtgcgtttagtggcaaacgtagtacgctggcgctggctatcgccggtgttacagctatgtcgggctttatggcaattccggaggctcgcgccgaaggattcatcgacgattcaaccttaaccggcggtatctattactggcagcgtgaacgcgaccgtaaagatgttaccgacggcgataaatacaaaaccaacctttctcactccacctggaacgccaacctcgattttcagtctggttatgctgctgatatgttcggccttgatattgccgtgtttacggcgattgaaatggcggaaaacggcgacagctctcacccgaacgaaatcgcgttttcaaaaagtaataaagcctatgacgaagactggtccggcgataaaagcggtataagcctgtataaagcagcggccaaatttaaatacggtccggtttgggcgagggcaggttatattcagccaaccggtcagacgctgttagcgccacactggagctttatgccgggtacttatcagggggcggaggccggggcgaattttgattacggcgatgctggtgcgttgagtttctcctacatgtggaccaacgaatacaaagcaccgtggcatctggaaatggatgagttttatcagaacgataaaaccaccaaagttgattatctacactcccttggggcgaagtacgacttcaaaaataacttcatactggaagcggcgtttggtcaggccgaagggtatatcgatcaatattttgccaaagccagctacaaatttgatatcgccggtagcccgttaaccaccagctaccagttctatggtacgcgcgataaagttgacgatcgcagcgtcaacgatctttatgacggcaccgcctggctgcaggcgttgacctttggttaccgggcggctgacgtagtggatttgcgcctcgaaggtacctgggttaaggctggcggtcagcaaggatacttcctgcaacgtatgactccaacctacgcttcctcgaacggtcgcctggatatctggtgggataaccgttccgacttcaacgccaacggcgaaaaagcggtcttcttcggtgcgatgtatgacctgaaaaactggaatcttccaggcttcgccatcggcgcttcctacgtttacgcatgggatgctaaacctgcgacctggcagagcaatccggatgcgtactacgacaagaaccggactattgaagagtctgcctacagcctggatgcggtttacaccattcaggacggtcgtgccaagggcacgatgttcaaactgcatttcaccgaatatgacaaccactccgacatcccaagctggggcggtggttacggcaacattttccaggatgagcgcgacgtgaaattcatggtaatcgcaccattcaccatcttctgatgcccgacgcggcaggttttgtgcctgccgcacgtttgaggaatttgctatgaaaaaactgattctcatcgccatgatggcatcggggctggtagcttgtgcgcaatcaaccgcaccgcaggaagacagtcgtctgaaagaggcttacagcgcctgtatcaacaccgcgcaaggttcgccggaaaaaattgaagcctgccagagcgtgttaaacgtgctgaagaaagagaaacaacatcagcagtttgctgaccaggaaagtgtacgcgtactggattatcagcagtgtctgcgcgcaacgcaaaccggtaatgaccaggcggtgaaagccgattgtgataaggtctggcaggaaattcgcagtaataacaaataagtgagagctgtaactctcgcttttcttatttcccttgtataaaaaagccaacctgcaggttggcttttctcgttcaggctggcttatttgccttcgtgtgcgtgctcatcttcgcggcaatcgccttcggcacagtgaccgtaaagatagagactgtggttagtcaggcgaatgccatgttttgcggcgatttcacgctgacgagcttcgatggaatcatcactaaattcgataaccttaccgcagtcgaggcagatcaggtgatcgtggtgatgttgctgtgttagttcaaatacggatttaccgccttcaaaattgtggcgggtgacgataccagcgtcgtcaaactggttcagtacgcgatataccgtagccagaccaatttcttcacccatatcgatcagacgtttgtataaatcttccgcactgacgtgatggttgtccggctcctgaagaacttccaggattttcaagcgaggaagcgttactttcaggccagctttctttagggcggtattgttatcagtcatgcggaatctgtcctgttactaagcggttcacttcattagaagaagtgacagaatttgctcttgagataatgcgtatcattatagaattgccacgcctaaatgaaaaccacaagtccctggcaaatattgttaataaaaacgtggcacagcttacatttacaacggcaaggccacttgaacaccgggacattgtacaggtacaacagcaaaagttacaaatttgtagcaattattttgattggcattatctattaatacggcgtagacatgagtctacgccgcatcacatcaggcattgagaatttcgtcgagatgcagctcttcagaaatttgtttaacccatttttctacacgttcagcggtcagttccggctgacgatcttcgtcgatagccagaccgacaaagtggtcatcatcagccagaccttttgacgcttcgaagtggtagcccgcggttggccagtgaccaacgatagttgcgccgcgcggttcaatgatgtcgcggatggtgcccaatgcatcgcagaagtattctgcgtaatcttcctggtcgccacaaccaaacagcgcaaccagtttaccattaaaatcaatctcttcgagagtcgggaagaagtcatcccagtcacactgcgcttcgccgtaataccaggttgggatgcccagcagcagaatgtcatatgcttccagatcttctttgctgctttttgcaatgtcatggacatcggcaacgtctttaccaagctgtttttgaatcatttttgcgatattttcggtattaccggtgtcgctgccgaaaaagatgccagtgatagccatgagtgaaataacctcttgaaacttattgaaatgggggtggaaaattgcccacggataaaggcaatcatagcagaacaggcagtcttgcggaatcagcaaacgagcaggactgcacactgtgctacatgaaagtggaaatttaaacgatgccctgactacgcagcgccgccagttgctgcattaacatctcttcgatcagctcgctacggctcatattgcgcgattccgccagctcgttcagtgcctcgacagcttccgcgttcagcttcagttcgacacgcttaaggccacgtactttgtcgcgttttagttggttgcgtttattaatacgcagctgttcatcgcgcgaaagcggattagttttcggtcgtcccggtcgacgctcgtgcgcgaacagatctaatgtcgtacggtccgtttgttctttggccatgatcttggtgacttcgggggaaacaatcagccaggcgcctgcccggatggatagcgcgccataatacatcagcgcgatgagtcacgccaacgtccacgcgcggaaagcgacgcggacgctgggtttttaatcagttgcgttaatcattgagatagcgacggatagcgcgtaataccgcatccggtttttcagcatggacccagtgacccgcgcctgcaatcacatgcgcccgagcctgtggaaattgtgccagtaaatcatcacggtactgctcgctaacatacggagaattgccgccagggataaacaggataggatgatcccatgccgggattttctcccaacccacaatatgcggatactgatcccacaatactggcacgttaaagcgccactccccatcaacaaaagatttcaacagaaactgaatcaccccttcttcattaagatgctggcgcattattgccgctgcttgctggcgtgtttgtgcgtctgattcactgactgcgttgatggccgcgaaaatctcatcatgacggcgaacgtgataatcgaccggcgcaatatcaatcgccaccagcttgtcaatgcgatcgggggctagtgcagtaagagccattaccgctttaccacccatggagtgaccgataaatgttgctttgtcgatctgctgtgcatccaggatatcaacaagatcctgcgccatcgccgggtaattcattaccggatctctcggtgaaagaccgtggttacgcatatcaacctggatgatattgtgattgtttaccagatcgcgagccagtacgccaaggttgtcgaggctgccaaacagaccatggacaagaacgatgggagaattattgtgctggttttgtgcagtttgcgcgcggatattcaatttcatggcaaagttctttttttcgcgttgtcgggttagggtattatgttgaccattgtgccacagggctgcaacaaataaggtttattccgagtttttctgcaagccaggcttgacgctatccgctgccgggatttattcatatactcctggcgacttgtattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggacgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgcctggtacgccgtattgggtgatcaccaacaccaacaccggccgtaaatgcagcatgatcgaacacatcatgcagtcgatgcaattcccggcggaattgattgagaaggtttgcggaactatctaaaacgttgcagacaaaggacaaagcaatggcaatccacaatcgtgcaggccaacctgcacaacagagtgatttgattaacgtcgcccaactgacggcgcaatattatgtactgaaaccagaagcagggaatgcggagcacgcggtgaaattcggtacttccggtcaccgtggcagtgcagcgcgccacagctttaacgagccgcacattctggcgatcgctcaggcaattgctgaagaacgtgcgaaaaacggcatcactggcccttgctatgtgggtaaagatactcacgccctgtccgagcctgcgttcatttccgtactggaagtgctggcagcgaacggcgttgatgtcattgtgcaggaaaacaatggcttcactccgacacctgccatttccaatgccattctggttcacaataaaaaaggtggcccgctggcagacggtatcgtgattacaccgtcccataacccgccggaagatggtggtatcaagtacaatccgccaaatggtggcccggctgataccaacgtcactaaagtggtggaagacagagccaacgcactgctggctgatggcctgaaaggcgtgaagcgtatctccctcgacgaagcgatggcatccggtcatgtgaaagagcaggatctggtgcagccgtttgtggaagggctggccgatatcgttgatatggcggcgattcagaaagcgggcctgacgctgggcgttgatccgctgggtggttccggtatcgaatactggaagcgcattggcgagtattacaacctcaacctgaccatcgttaacgatcaggtcgatcaaaccttccgctttatgcacctcgataaagacggtgcgatccgtatggactgctcctccgagtgtgcgatggcgggcctgctggcactgcgtgataagttcgatctggcgtttgctaacgacccggattatgaccgtcacggtatcgtcactccggcaggtttgatgaatccgaaccactacctggcggtggcgatcaactacctgttccagcatcgtccgcagtggggcaaagatgttgctgtcggtaaaacgctggtttcatctgcgatgatcgaccgtgtggtcaatgatttgggccgtaagctggtagaagtaccggtaggtttcaaatggtttgttgatggtttgttcgatggcagcttcggctttggcggcgaagagagtgcaggcgcttccttcctgcgtttcgacggcacgccgtggtccaccgataaagacggcatcattatgtgtctgctggcggcggaaatcaccgctgtcaccggtaagaacccgcaggaacactataacgaactggcaaaacgctttggtgcgccgagctataaccgtttgcaggcagcagcgacttccgcacaaaaagcggcgttgtctaagctgtctccggaaatggtgagcgccagcaccctggcaggtgacccgatcaccgcgcgtctgacggcggcaccgggtaatggcgcttctatcggcggtctgaaagtgatgactgacaacggctggttcgccgcgcgtccgtcaggcacggaagacgcatataagatctactgcgaaagcttccttggtgaagaacatcgcaagcagattgagaaagaagcggttgagattgttagcgaagttctgaaaaacgcgtaaacatatcaaataagaaaaagggcggtcggaagatcgcccttttttgctttgcttaattaaccgtgtttatttttcagttcaaagcgtggtgagaccagaccatacagtgtccaaccgaggaaggtcacgatggaaccgtatagcatggcttcttccccggatgagtacagcgcataaaagctgtacatcgcgccaacaaaagcaacaaagtttgcaactttcgcttttgaggggggcacattagcgaccttctgaataatgactaatgccgccattgacagaatatacgggatgatattggtcaccacggccaggttaaccagcacgttgaactgactgttcagcgacgggctaatggtcatcagtgataatccgctctggatgatgacaatggtcagcattccctgtactggtgcatcgactttgctcacacgggagaaaattttcgggaagtacccttcatcggcagaagatttaaacacctgggcaatggtgaactgccagccaagcagcgaaccgcagcaggacatcaccatcagcgccataatgactttacccacttccggcgtgaacatctgcgcgaaggccagaccaaatggtgccgttgaatttgccagctccatatttggcacaatcccggcaatcacgttggtggagacgatataaatcaccgccgcacctaacgtaccgccgagtaccgcgattggcacattacgttccgggttttccactacatcagtattcgcacacgcagactccagaccaagaaaagcccacagcgtcatagcgatggaagaacctaccgcactgaagaacggtgcatgatgcggattccaggaatcaacgtaaagcgtcgggctaaaccagaaccagccgataatgcacaggcctaccaccggaataatgaccccccacacggtaatgctactgatttgcccggtaatgcgcgcaccaccaaagttagccacggtacaaatccacagcaccccgatggtcgcaagaccaatctgcactggcgacaaactcgcgccgagcagttcggtgccgtaaccaaccgccgaaatagcaatcgcgacgttagcaatcagcagcgagacgccgtaggtatagttcgccataaagttaccggatttaccgaaagcatactcggcataaccgcccatacctcctgatttacggctgaacataccgcattttgcgaatgcccatgccagtgccattgagcctacggctgtcaccagccaggagataattgagattgtcccgacttcggcaagctttgtcggcagcatgatgataccggagcccatcatgttgaccatcgtcagtatggttaactgaacgacacccattttgttcgatttcgcctgactcataatttttcccctttcaacagggcgctttgcgcatcacgaggcttgatgacatagcaccaaacttgcttacgaccatcatgttcttcgatatagacaccctgcagctccggtgcaaaacctggcagcaggttgatgccttcttccagagcgctgaagtaacgcagaacagcaccaccccagatttcaccaggaacaacacacagcacacccggaggataaggaagcgcaccttcggcagcgatacggccttctgcatccggcagacgaaccagctccacttcaccgcgtaagtaggcgtagttggcttcttgcggattcatgctgacgcgtgggaagtgttccttacggaacatctctttttgcagttgtttcacgttgtggcgggcatacaaatcatgcatttcctggcacaactgacgaagggtataaccggcgtagcgctcttcatgctgtttgtagatggaaggcagtacttccgccaggggcgcatcagcttccagtagtttttcgaagcgtaccagcagggcaacaagttgctgcagtttggccatatcttctgccggagtcagcaggaagaggatggagttaagatcgcatttttccggcactacgccattttcgcgcaggaagttagcaagaatcgttgcgggtacaccgaacgcttcatattcgccgttacgtgcatcaatacctggagttgtcagcaacagtttgcacggatcgacaaagtattggttctctgcgtagccttcaaaagaatgccagtgctcaccgggtacaaatttaaagaagcgcagatcaaccgcaatttgcgctgtttcatacgactgccagggtttaccatccaccagttcaggaacgaacgggcgaatgtgctggcagttatcgaggatcaatttgcgggcattaataccgttaaccacacaatccatccacatattacgaccgctgacaccttcatgcattttggcgttgatatccagtgcggcaaacagcggatagaacgggctggtggaggcgtgcatcataaaggcgttgttcatgcgtttgtgcggtacataacgctgttgccctttgatatggctgtcttttttatgaatttgtgaagtctgagaaaaaccagcctgttgtttatgcacagattgcgtaaccagaatacccggatcgttctcattaagctccagtagcagcggcgaacagtccgccatcatcggaataaactgttcatagccgacccatgctgagtcaaacaggatgtagtcacacagatgaccgattttatccaccacctggcgggcgttataaatagtaccgtcgtaggtgcctaactgaatcacagcgaggcggaacggacgcgcctcttttgcccgttgcggtgcaacttctgtaatcagttcacgcagataactttcttcgaagcagtgcgcatcaatgccaccgataaaaccatacgggttacgtgctgtttccagatacaccggtgttgcaccagcctgtagcaaggccccgtggtggttagacttatggttattgcggtcaaacagcaccagatcacccggtgtcagcagggcgtttaaaaccactttgttggaagaggaggtgccgtttaaaacaaagtacgttttatcggcattaaacactttagccgcatgttgctgtgcaatgcatggcgcaccttcatgaatcagtagatcgcccattgcaacgtcggcattacacaagtcggagcggaagagcatttcgccaaaatattccacgaactgattgcctgccggatggcgacggaaaaactcacctccctgatgacccgggcagtcaaaagcgctattgccctgattgacataatcgaccagtgcgcggaagaagggcgggcgcagttgcgtttcataatggctggcagcggtttctaactgacgtccataaaactctttccgtgattcgcaatgctcgaagacaccagaaatacgtggcagatattctgctggtacacgttcttcattttccgttgcaataaaaacaggaatgccatagccagtagcgtctatttcatcgagttttccatgttcaacatcattgactgataaaataatggcggcaacgtcaatataattacttttgtcaatattcacgcattcacgatgagtggaaaaacaatccgggcaagaacggctaacggcaatttttaattctgacattttgttcatctctttatttcaggtaatagcaggtcctcaatttctcaaaggagaaattgatcacgccggaaaaaagcaaaaccccaccgctgataaataaatcagtagtttgctttttgcagatgcaataacccagaccagcccggtaactggctatactcgtcatacttcaagttgcatgtgctgcgactcgaattatttagagtttgaaagggttagcagtatatgagcaccgagggatacaggtattaacctgtaatgcttaaagtcagggagacctgtacgctggggtgccctttagtcagaagactagcgggcattaaagaaatgaaagtcaaaactattacgatgggcaaacttcatgatatgggttgtccgccttatatgaggcattaagcggttattattttccatttacctttacctttttctgtgtcagttgaaggtagggttattctatccatgaaatagctataatctgtgaagaagatcaaaaaaaaacgataatatcccaaataataaatcattaatgatgaatagcaccatattagatgctgttttgttgtttaaatgttgcaattttgtgggttgtattttcattaagaaattaaacctgccaaataataattttcggggcaggtttaataataaactaataattatttaagcgtatttattgaataataattcatggcataaaccgatacccaataccggtttcagtaataaaatggcgggggcgggcgggatcttgctccagtttttgtcgcagatgccccatataaatacgcaaatagtggctgtgttcgaccgcgtttggtccccacacctgattgagtaactggcgctgggtgagcacttttccggcgttgttgagcagcacggccagcaggcggaactcaatcggtgtgagatgcacctcttcctcgccgcggtggataacgcgggcggctaaatcgacggtaacatcagaaaatttcaccagcggatcgggcgtggtggtggcggagtggcggcgtaatgcgacgcgcagacgggcctgcaattcgccaatgccaaacggcttactcagataatcatccgctccggcatccagcgcggcgattttatcgctctcttcgctgcgtgcggaaagcacaatcaccggcaccgcgctccactggcgcaggtcgcggataaactcaatcccatcaccgtcgggcaggccgagatcgagaataatcaaatctggcttacgggttgccgcttccagcaagccgcgttgcagcgtttcggcctcaaagacgcgcataccgtcgccctccagcgccgtgcgcagaaagcgacgaatagcctgttcatcttcaacaatcagaacgtttgtcacatatcctcatgaaattcttcaagttcaggggctgtttgctggggaagtgtaacacgaaaacaggcaccaccttccggtcggttgaatgcggtaatggtgccgccgtgtacatccactatcgcccgacaaattgccagcccaagccctacacccggtaccgccgactctttattcccgcgagcaaacttatcaaatatcgtctgctcctggcctggtggaagaccggggccgttatcccagacatccagttgtagattttcgccctcaacgtgggcattgataccaatttcggcctgcgcccccgcatatttcaccgcgttctccagcaggttaatcagcacccgttcaaagagtggcccgtcaacgtggattaaggtcagcggctctggcagagaaagattgatgggcgacgataaacccggttccagcatttgcagcgcgctgccgaccacttcttccagcgttaaccactctttcttcaaattaaagccgccggactgaattcgcgccatatccagtagattattcaccagtcgggtggtgttcagcacatgctgacgaatctcgctggcctggcgagcgtggggcgatccttcgcttgccagatcgagcgttaagatttctgcctgaccgaacagcaccgtaagcggcgtgcgtaaatcatgcgaaagtgccgccagcagggcgttgcggatctgttcacgttcgcttgccatccgcgcctgttcttcgctggcggtcagtgtcagccgctcaagggcattggcgactaacaacgtaaatgtttccagcaggcgctgctgttccgggatcatcaactggcgcagattccccggttccaccaccaccagtccgtaggttttctcgccgctttttagcggcaaaatctggtacggtacaccgggtaacgtgtcggtgcccgcgcccgcaggcaggcctttatcaaaactccactgcgcgatggcatcgtcccacggcgtcattccttgcggatgtgttaaaggctgcaatttaccgttgtcatcaggcagcaacacctggctacgggcatgaaacgtggaggcaataaactgttcgctggtggcggcgatatcctgcgaactacggcccacagccagagctttggacatttcatataagtgccgtgtgcgttgttcgcggtaacgggctacccgcgcctgataacgcacgccagcagtaaggttcccgatcaccagcccgacggttaacatcaccgcgaaggtcagcagatattgcacatcagagacggcgagcgtgccgcgtggggcgataaaaaagagatcgaaactcaccacattaatgacggtggcaaccaccgaaggccagcgtccgtaaaatagtgccaccaccacgacgccaagcagatacagcatcaccaggttggcggcatcaaacgccatcagccactgcatggcaattaaggtgataacggcgcataacgcggcggcaaccacgcatccctgaatctgtacccgccacttgtctttaaaagagcggctatccggcgcgttattaagcgtgcgggcggggggggcatcaagtgcgaccagcacctgatcgagatcgggggcgatacgcgccagtcggtcagcaaacgtttcccgacgccaccagcggcgcgaggccgggcgaccgagaataatcttgccgagattatgttcacgggcataacgcactactgctttttcttccgctggatcagaaagtgttgccgtctccgcgcccagctcctgcgccagacgtaaggcgctgagaattgcccgacgttttttctccggtaagcgatgcagggcaggggtttcaacatacaccgcgtgccagacactgcccaggcgcgaggccaaccgcgccgccgcgcggaccagtttctcactgccggtgttatgcccgatgcataataggatcgcgtcgcgtgtgtgccagactttctcttcgccaggatgcccccgccaggcgcgcatttgctcatctacgcgatcggcagtacggcgcagtgccagttcgcgcagggcgatcagattacctttgcggaaaaaatgttcaatggcgcgctccgcctgcccggcaatatagactttgccttctttcagtcgctggcgcagatcgtccgggggcaagtccaccagcaccacgtcgtcggcggcatcgaaaaaaggatcgggcacggtttcccgcacctgaattccggtgacgccgctgaccacatcattcagactttccagatgctgaacgttgacggtagtgaaaacatcaatgccagcttccagcagctcctcaatgtcctgccagcgtttaggatgacgtgaacctggcgcattactgtgcgccagttcgtccattaagatcagtgccggacggcgggcgagggcggcatcgagatcaaactcgctgatgtgccgcccacggtacgcctggcgttttaacggcagaacagccagacctttcagcatggcggcggtatctttccgaccgtgggtttctaccacgccaaccacaatatccagcccttgcgcccgcagtcgctgggcttccgccagcatcgcccaggtcttcccgacgcctgcgcaggcaccgaagaaaactttcagcttcccccgatgcggcgcggcagcttgttccagcagacgatcggggtcgggacgtaagggttcgttattcatcaagcttatccagtgccagattgagttcgacaatgttgacgaccggctggccgatatatttcaccagcggttgttggctgtattttgcgatcagttgcgtgagctgttcaacgctgagattacgcgctttcgccacgcgtgggatctgccaggccgccgcttgcggggtgatgttattgtccagcccgcttgctgacgccgtcaccagttcaaccggaacgttcgtgctggcattcgggttagcagcccgtaatgcagcaacgcgtgcggctatctgtttatccagctccgggttactgaccgccaggttgctcccgccagaagcctgtggattatagggcatttctgctgttgccgacgggcgaccatgaaaatagccgttgccggtaaaattttgcccgattaatgccgaaccgcgcaccgtatcaccttcacgaatcaatgaaccgttggcctgccagggaaaccaccattgccccagtgcggtggtcagcagcgggtaaacgccgccagtaatcaataacagaaagagaaatgtcgataatgccggacgtaatccactcatggtaaacctcacaccagaccgcaaatggttagcagtaaatcaatgactttgataccaataaacggcaccagcagcccacccagaccgtaaatccataagttacggcgcaacatggcagaagcggtaagcggtttataactcacgccttttaacgccaggggaatcaaaaagacgataatcaaggcgttgaaaatgaccgcactgagaatggcggagtcgggcgaatgcaggcgcatgatgttcagcgcatttaactgcggatacgttgccgcgaacgccgctggaataatggcgaagtatttcgccacatcgttggcaatgctgaaggtggtcaacgagccacgggtcatcagcatctgtttgccaatgtgcactacctcgatcaacttggtcgggttggagtcgagatccaccatattgcccgcttctttcgccgcctgggtgccggagttcatcgccaccgcaacatcggcctgtgccagcgccggagcatcgttggtgccatcgccggtcatcgccactaaacggccttccgcctgatactgacgaatcagtgccagcttggcctccggtgttgcttcggcgagaaaatcatcgacacccgcttccgcagctatcgcggcggcagtcaggcggttatcgccggtaatcatcaccgttttaatgcccattttacgcagctgggcgaagcgctctttaataccgcctttgacgatatctttcagcgcaataacgcccagcacacgagaaccttccaccaccaccagcggcgtggctccctgacgcgcaacctgatcgactttttgatcaacatcggcagggaagtgaccgccgttagcctcaacatggcggcgaatggcatcgacagaacctttacggatcatgcggttgtcgatgttgatcccgctcatccggctttgcgcagtaaacggtacaaaggtggcatggagcgactgcacatcgcgctcgcgcaggttaaaacgctgcttggcgaggatcacaatactgcggccttccggtgtttcatcagccagcgaagccagttgtgcggcgtcggccagcgctttttcctccacgccttgtgcggggataaactctgacgcctgacggttaccgagggtgatggtgccggttttatccagcagcagaacgtcaacatcacccgctgcttcaactgctcgcccgctggtggcaataacattcgcgcccagcatccgactcatcccggcgacgccaatcgctgacaacaggccgccaatagtggttgggatcagacagaccagcagtgccaccagtaccgttacgctgactgcattaccgccccacgcggaaaacggccacagcgtggcggttgccagtaaaaagacgatagtcagggcaatcaggagaatggtcagggcaatctcgttcggcgttttacgtcgctgcgcaccttccaccatcgcgatcatccgatccagaaatgtctcgccggggttaacgctgcactcaatcaccagccagtcagaaagaatacgcgtgccgccagtgacggaggcaaaatcaccgccggattcacggatcaccggagccgattccccggtgatggcgctttcatcgaccgatgcgccgccttcaatgacttcaccatcgcaggggataatatcgccagcttctaccagcacgatgtcacctttacgcagttgatcagcaggaactttgtccgccgcagcgccatatttcggttcgcgcagtttgcgagcaaaagcggtttttttcacccctttcagactgttggcctgcgctttactgcggccttctgccaacgcctcggcgaaattagcgaacagtacggtgacccacagccagccgctaattgccgcgctaaacagcgcattgccaggcatcacaccgcttgccatcgcgatgctaatacaggtggtcagcagactgccgatccagacgataaacatcaccggattgcgccattgcgcctgcgggtttaattttttcaccgcttctttcagcgcctgaacgacaagtgttggttcgaatagcgccagttgtttacgactcatattcagtgctcactcaatatcatcaggagagatattccgccaccggaccaagcgccagggcagggataaaggtcagtgcgccaaccagcaacacggtgccgattaacaggccaacaaacagcgggccgtgcgttggcaatgtgccggagctggcgggttggctctttttactcaccagcgaaccggcaattgccatcaccgggataatcaccccgaagcgcccgacaaacatgcacaacgccagtaaacagttccagaatggagagttggcgcttaatccggcaaaggcgctgccgttgttgttagcggcggatgacacggcgtacagcacttcgctaaaaccatgcgggccagggttgagcatggcgctacgttcggcgtcggtcatcattgccagcgccgcgcccatcagcaccagcgtcggggtgaccagaatcgccagtgcagtcagtttcatctcgcgtacgtcgatttttttacccagatattccggtgtacgaccaatcatcagcccggcaataaacaccgccagcaggacaaacagcatcatgccgtaaaggccggaaccgacgccgccgaataccacttcaccaatttgcatcaaccacatcggcaccatgccaccaagagcggtaaacgaatcatgcatcgcaatcaccgcgccgcaggaagccgccgtagtcacgaccgcaaacaggctactgaccagcacgccgaaacggctctctttaccttccatattgatgctgctgtccgcgccgagcgccagcagatgcggattaccctgaacttctgcccacatcactacgcctacgcagatgacaaaaattaccgacatcgcccacagcaacatgcgcccctggcgacgatcgcccgccacttcaccaaaggcaaagcacagcgctgttgggatcaagaaaatcgccagcatttgcacgaagttggtcagtgcggttgggttttcaaacggatgcgacgagttggcattaaaaaagccaccgccgttagttccgagcattttgatcgcttcctgagaagctactggccccattggtaacagctgttgcgatccttcaatggtcgtcacagcctgataaggcaaaaagttttgcagcgcaccttgttgtataaaaaacagtgcgatcaacaatgccacaggggctaacacccataacgtgatgcgtagcagatcgacccaggcattaccgagcgtgctcatgctctggcgggtaaacgcgcgaataagcgcaaaaatcaccgcaatcccgctggcggcagaaagaaagttttgcaccgttaagcccgccatctggctgaaatagctcaacgtggtttcaccgctataagattgccagttggtattcgtgacaaagctgacggcggtattgagcgccagatcccacgacagccccggcaactgctgtggattaagcggcagatagtgctgaccgagtaacataaaaaacagcaccgccagccccagcatgttcaggccgagaatggcacagagatactgcttccagttcatctcactgtcagagacgccaggtaaacgaaaaagtacgcgttcaacacccgctgtaccgggaagaggtatgtcattaatcagccgcgccagcccgctgcctaaaggacgtgccagcaccattaataccagtaaaaacgtggcgataagtaagaacccttgcgcagccatcagaacgcctccgcattgatcagggcataaaccagataacccagtaataaaaacaccagcaacacgccggctatcacgcctgcactcacagtgcacctccagtggcctaaaagtgataccggaagggtagagttctggctgcaaagatttcgcaaaaatctgcgggcggggtgtaaaaaaagtataaaaatggcaaaagccatgacttaactaatgcttagtattaatttaacttttatgtaacttaattacacggtgaatgtaaataaatcatcaataagcaaaaataagtggtcggatgagtagtaaaattacacaaacagcggtactattttcatcagataaacgaattcatttttccggtgctattcaccgggtagatacaaaagggggagaaaagtatggaactctacaaagaatatcctgcatggcttatctttttacgccgtacttgtgcggttgcagcgggcgttctggcgctgcctttcatgcttttctggaaagatcgcgcccgcttttatagctacctgcaccgcgtctggtcgaaaaccagcgataaaccggtgtggatggatcaggccgaaaaggcaaccggtgatttttactgattgccaaacatgacgtttaaagaaaaccgccggtggaaacgctggcggttttcttttttcggcgtctacacttactcctgtaaaccgttcaggagcagtaatgaatcaacaactttttgatgacagcacccttatccgcatttttgctttgcatgagttacacaatctcaaagatcgaggactaacgcgcggggcgcttctcgattatcacagccgctataaactcgtctttctggcgcattctcagccggagtaccgcaaacttggcccgtttgtggctgatattcaccggtggcaaagtctggatgactattacaaccagtaccgccaacgcgtaattgttttgctttctcaccctgccaaccggcgtgatcagactaacgttttgatgcacgttcagggatattttcgcccacatattgattccacagaacgccagcagctggcggcgcttatcgacagttatcgccgtggcgagcaatcgcttcttgcgccgctgatgcgtatcaaacactatatggcgctttatcctgacgcctggctttcagggcagcgttatttcgaactttggccgcgtgtgattaacttgcgccatgcaggagttttatgactacccatctggtctggtttcgccaggatttacgtcagcacgataatctcgcgctggctgccgcctgccgcaattcgtctgcgcgcgtgctggcgttgtatatcgctacaccacgccagtgggcggcgcataatgtgtcgccgcgtcaggctgaacttatcaatacacaacttaatgcgctgcaaaacgcgctggcggaaaaaggcattcctttattgttccacgaagtggatgactttgctgccagtgtcgaaacagttaaacaggtgtgcgcggaaaatcgcattacccatctgttttataactatcagtatgaggtgaatgagcgggcgcgggatgtgcaggctgagaggacgctgcgtaacgtggtgtgtgaaggatttgatgacagcgtgatcctgccgccgggggcggtgatgactggcaatcatgagatgtacaaagtctttacgccttttaaaaacgcatggttgaaacggctgcgggaagggatgccggagtgcgttgctgcaccaaaagttcgtagtagcggatcgatagagcccgcgccatctattacgctgaattatcctcgtcagtctttcgatactgcgcatttcccggtggaagaaaaagcggcgattgcgcaattacgccagttttgccagaacggtgccggagagtatgagcaacaacgagattttccggcagtggaaggcaccagtcgtttgtccgccagcctggcaacgggcgggttatcgcctcgccagtgtttacatcgcctgttggcggaacaaccgcaggtgctggaaggcggaccggggagcgtctggcttaatgagctgatatggcgcgagttctaccgccatttgatgacgtattatccttcgctgtgtaaacatcgtccgtttattgcctggacggatcgtgtacagtggcaaagcaatcccgcccatttaaaggcctggcaggagggcaaaacgggatacccgattgtcgatgctgccatgcgtcagcttaacagcactggctggatgcataaccggctacggatgattacagccagttttctggtgaaagatttgttgatcgactggcgcgaaggcgagcgatatttcatgtcgcagttgattgatggtgatttggcagctaataacggtggctggcagtgggctgcttctacgggtactgatgcagcgccgtattttcgtattttcaacccgacaactcagggcgagaaatttgaccgcgaaggcgaatttatccgccagtggctaccggagctgcgcgatgtaccggggaaagcggtgcatgagccgtggaagtgggcagagaaaacaggtgtgacgttggattatccgcaaccgatagtcgatcacaaagaggcaaggctgcgaacgctggcagcgtacgaagaagcgaggaaaggagcctgataaaacgcagcgagcgttttatcaggcatggtgctggcttattaagactccagcgccagcgcgcggtttctgaacttaagcgcctgatacagccaaatcatcagtaccagtcctacacacgccagtgcgccccaggtaatttgatcaaatacttcaatatatgcattgatggagtagttgatcgccccggaagcatcaaacgaagcctgcgatgtctgatcggcaatcacgcccgccagatagttcgcaatcgcgccggaaagcagcatataaatgccggttaatacgccggtcacgccggggatttcaatgcgcgtaatctgcgacatagcaaccggatcgataaacagttccgcaaagcccatcaccgccaggcctaacaccatcagtggcagagaagagtgaccatacattgcggaccagcgggcgcttaaggtcagaatgcagaatccggcgctcatcaggccaaggccaagagcaaattttccccagatgcgcacggtacgattacctgcgacgctttctttaaccacccacgccaggaacacaccgcacagcataactgcgaaggcattaatcgactggaacatagcagtcggaacggtataaccaaatatatcgcggttaacgaagcggtcgatataaaggctaatcgagctacccccctgttgtgcgaatgcccagaacaacatgctgaagaaggtgagggtaacaatcagccccagctccttacgctgtttttggttttctgctttgcgataaatttttgccagaaccccaaggccaatgatcgttgcgacaatcaaggcgtataccgaccactctttccagaacagtacggtaatcagcgcaggcgttgccaccagcagaaccagtagccatccccagttgggcaggagaaagtttgtcgcacgcagtacctttttgttaacgccgcgggtatgtgtgaaatgacgattgccacataagaaaatgaccagacccgcgatcatacccaccgctgccaggccaaagcccatcgcccaactgtactcttcctgggcgaaaccacaggcgataggtgcgataatagaccccacgttacccgccgcatacatcagcgagaaaccgccatcacgacgtggatcggttggctcatacagctcgccgagcaggcaactgacgttggatttaaacagaccatagccgcagacgataatcgccagggacagatagaggaatgacggatggatctcactggcacccagcaccacatgaccgatcgccatcaacaacgcccccagcatcaccgccatgcgattgccgagaactttatccgccaaaaagccaccgaggattggcgtgacatataccagcgaacagtaggcgctaaataactcgtaggcgtgattatcgctatattttagttgattggtgagatagaggatcagcagggcacgcatgccgtaaaagctaaaatattcccagatttgcagcgcaacgacatagtaaatagcgcgcggttgtgatgcgtgtttattcataataattccacaattgactgcaacgtcacgtaatagttgcgcggcgtgcttgtgtttccttaaagttaaaactttgatacagatctgattatttatgcaatatgctgtctgattgcataaatatacattagctgaagcgtgatgatataaacaatttgcgtcttttggcgtcgggtttgtttcttaatatgtcaaaagattggctatcgacgaacaggcgaggtaacgctatgttaacggtgtagctatcagaatacggaaggcgcgaagatgaaaaacaccgaactggaacaactgattaacgaaaaactgaacagcgcggcgattagtgattacgcgccgaatggtttgcaggtggaaggcaaagagacggtgcaaaaaattgttaccggtgtcactgccagccaggctttgctcgatgaggcagtgcgtctgggcgcggatgcggtcattgtgcatcatggctacttctggaaaggcgaatctccggtcattcgcggaatgaagcgtaaccgcttaaaaacattgttggcgaatgatatcaacctgtatggctggcatttgccgcttgacgcacatcctgagctgggcaataacgcacagctggcggcgttactggggatcacggtcatgggcgaaattgagccgttggtgccgtggggcgaactgaccatgcctgtgccgggactggaactggcctcctggattgaagcgcgtctgggacgtaagccgttatggtgtggcgataccggacctgaggtggtccagcgcgtcgcctggtgcacgggcggcgggcaaagttttatcgatagcgccgcgcgttttggcgtggatgcttttattactggcgaagtttctgaacagaccattcattcagcccgcgagcagggattgcatttttatgctgcgggtcaccatgccactgaacgcggtggtattcgcgcattgagcgagtggctgaatgaaaataccgatcttgatgtgacctttattgatattcctaatcctgcataacgaataatcagagggatcgaaagtgcaacgagcgcgttgttatctgataggtgaaacggcggtagtactggaactggaaccgccggtgacgctggctagccagaaacggatctggcgactggcacagcgtctggtggatatgccgaatgtggttgaagccattcctggcatgaacaatatcacagtgattttgcgtaatcctgagtcgctggcgctggatgccatagagcgtttgcaacgctggtgggaggagagtgaggcgctggagccggagtctcgctttattgaaattccggtggtttacggtggcgcagccggaccggatttggcggtggtcgcggcgcattgtggattgagcgaaaaacaggttgttgaattgcactcctccgtggaatacgtggtctggtttttaggttttcaaccgggcttcccgtatctcgggagtttgccggaacaactacacacgccacggcgcgctgaaccgcgcttgcacgttccggcaggttctgtcgggatcggcgggccgcagaccggtgtttatccgctggcaacgccgggtggctggcagttgattggtcatacctcactcagcctgtttgatccggagcgtgacgaacccatcttattacgtccgggagacagcgtgcgctttgtaccccagaaggagggagtatgctgaagattattcgtgcgggcatgtataccactgtgcaggatggcggtcgtcacggttttcgccagtcgggtatcagccactgcggcgcactggatatgcctgcgctgcgcattgctaacctgctggtgggtaatgacgccaacgcccccgcgctggagatcacgctcggtcagttaacggttgagttcgaaactgatgggtggtttgccctgacgggtgccggttgcgaagcgcggctggatgataacgccgtctggaccggctggcgattgccaatgagagcaggccagcgtttaacgcttaaacgcccgcagcacgggatgcgcagttatctggcggtcgcgggtggtattgatgttccgccggtaatgggatcatgcagcaccgatctcaaagtggggattggcgggttggaaggccgtttactgagggatggtgaccgactcccgattggcaaagcgaagcgtgattttatggaagcgcagggcgttaaacagctgctgtggggcaaccgcattcgcgccttgccggggccggaatatcatgagttcgatcgcgcctcgcaggatgcattctggcgttcgccctggcagcttagctcgcaaagtaaccgcatgggctatcgcttacaggggcaaattttaaaacgcaccaccgatcgcgaactgttatctcacggtttgttaccaggtgtggtgcaggtgccgcataacgggcagcccattgtgttgatgaacgatgcgcaaaccaccggtggttacccgcgtattgcctgtatcattgaggctgatatgtaccatctggcgcaaattccgctcggtcagccgattcattttgtccagtgttcactggaagaggcactgaaagcacggcaagatcaacaacgttatttcgaacaattagcatggcggctgcacaatgaaaattgacctgaacgccgatctgggcgaaggctgcgccagcgacgcagaactattaacgctggtttcctctgccaatattgcctgtggatttcatgcaggcgatgcgcaaaccatgcaggcttgcgtgcgtgaagcaataaaaaacggtgttgcgattggcgcgcacccgagttttcccgacagggaaaattttggtcgcagcgccatgcagctgccgccagaaaccgttttcgcccagacgctgtatcaaattggcgcgctggcagcgattacccgtgcgcaaggcggcgtaatgtgtcatgtcaaaccgcacggcatgttatacaaccaggcggcgaaagaggcacaactggcagacgccatcgccagagcggtatacgcttgcgatccggcattgattctcgtcgggctggcaggaagcgagctgattcgtgcaggcgaacgatatggcctggtaacacgcgaggaagtgtttgccgatcgcggttatcaggcagacggttcgctggtgccgcgaagccagccaggcgcgttgattgaaaacgaagaacaggcgctggcgcaaacgttggagatggtgcaatacggcagagtcaaaagtatcaccggcgaatgggcaatggtcacggcgcaaacggtctgcctacatggcgatggcgagcacgcactggcgttcgcccgccgattacgagctacatttgctgaaaaggggattgttgtcgcagcataaccccgcttaataaagaatgaaaaaaggatatcaccatgcctgaaggcccggagatccgccgtgcagcggataacctggaggcggcgatcaaaggcaaaccactaactgatgtctggtttgccttcccgcagttaaaatcttatcaatcacgacttatcggtcaacacgttacccatgtggaaacgcgtggtaaggcgttgttaactcatttttccaacgacttaacgctctacagccataatcagctttacggtgtctggcgcgtggttgatacaggcgaagagccgcagaccacgcgagtactgcgggtaaaactgcaaacggctgacaaaaccattctgctttatagcgcctcggatattgagatgttgaccccggaacaactgaccacgcatccgtttttacaacgcgttggtcccgatgtgctggatccgaatctgacgccggaggtggtaaaggaacgattattgtcgccgcgctttcgtaaccgccagtttgctggattactgctcgatcaggcgtttctggcaggacttggcaattatttgcgggtggagatcctctggcaggttgggttgaccggaaatcataaagcgaaagatctcaatgcggcgcaactggatgcactcgcacacgcgttactggatactccgcgactttcttacgctacgcggggccaggtggatgaaaacaaatatcatggggcgctgtttcgctttaaggtttttcatcgtgatggcgaaccttgcgaacgctgtggcggcatcattgagaaaaccacgctgtcatcgcgcccgttttactggtgcccaggctgccagcactaggccgaacgcttcggcgcataggttgaaataaaccgtgcgatggcaggccccgtcagcaaaatactgaacaggcgcagggtttgcatcgccatgatgagcgccatatcggcattgctccctgcggcgatgaccgccacggtatcaagcccgccggggctggtggcgaggtaggcggtcataaaatcaatatgcataaaccgggtcagcccccacgccatacccgcacaaatagccagcagagcaaaaatcgacagcaggatttgtggcagtgggcgcaatgcccgcagtaatatttgcttatcgaaaccaagaccaatccgccagccaattgccatatatgccatcgccagcagccattccgggagttcaatcgtgatgagctgaccagactggagcactgcgcccgccagcatcgggatgagcatcgtgccggaaggaagacgtagcaagcatcccgccgtaccggcaacgaccgcgagcaaaatcgtaagcaggagattaatgctcactggcgggaaccagacgatctgctggttaaccgcttcagtgttatcgcccagcatcatgcgggtgaccagaacagcggcccccgcgacgaacagcactcgcagatattgcataaacgccaccaggcgaatatctgcgccgtaatcttgcgccattgcgaccattgccgccgcgccgccaggagaagaaccccaggccccggtatttccaggcagtgagctatagcgcaccaataaccaacccacgatggcgctggaaagcagcgtcaccagtaaaatcgcaagcacgatcggccagttgacggccagcgtggtgagaatcgaaccagtgaggttttgtgcaatcatgcagccaagaatggcttgggcagcgagaaaagcggagcggggaagttgcagagtgactccgcgcatactgaagatgatcccggcgatcatcgggccaagcaggagtgccgccgggagatgtaaagcgaggaagccaatagaaaggagaagtgacagaacacataacattccccactgcaatacaggcattcttcgcttcctcattattttatctttggtgtatcgatacagcataaagaaagctgggtctggaaaaaataacggtaatcaaggaaaaggggaaaatcagcaataatctgaatacgttgccctttccggctgaaaagggcgtcgtgttaaatcagttatagttaatcttaaaaagtaccactgtatcgaagggacccgccgcgatgggagtgccaggtgtggacgataattcagccgtataggttttttcgtagatcagcatatcactggtgaaatcggcgtattcagcatatttattgaatgtataaggcgaggcgttttcatccagtatacgtagcttcagaccattaccaatcaacaatgctttatcttcttcaaccaacgttttttcggtataaaacgaggagctgaccttaaatccgtcggtacactggtcattttgcgattttgttgtcttgatactgaatgttttcgacattgtgtggcggcgaatatccagtaagttaaatttacccaaatcaatcaccagtgtttccggtgaaatattttttcaccattattaatgggtatttgcatctggtttaatttttacaattttttatgttcagccatataaaaagaacccgctctattaaaggcgggtccggaaagtgaacggcttagcaatcaaccattaacgcttgatatcgcttttaaagtcgcgtttttcatatcctgcatacagctgacgcggacgggcaatcttcataccgtcactgtgcatttcgctccagtgggcgatccagccaaccgtacgtgccatagcgaagatcacggtgaacatagaagacggaatacccatcgctttcaggatgataccagagtagaaatcgacgttcgggtacagttttttctcgataaagtacgggtcgttcagcgcgatgttttccagctccatagccacttccagcaggtcatctttggtgcccagctctttcagcacttcatggcaggtttcacgcattacggtggcgcgcgggtcgtagtttttgtacacgcgatgaccgaagcccatcaggcggaaagaatcatttttgtctttcgcacgacgaacaaattccggaatgtgtttaacggagctgatttcttccagcattttcagcgccgcttcgttagcaccaccgtgcgcaggtccccacagtgaagcaatacctgctgcgatacaggcaaacgggttcgcacccgaagagccagcggtacgcacggtggaggtggaggcgttctgttcatggtcagcgtgcaggatcagaatacggtccatagcacgttccagaatcggattaacttcatacggttcgcacggcgtggagaacatcatattcaggaagttaccggcgtaggagagatcgttgcgcgggtaaacaaatggctgaccaatggaatacttgtaacacatcgcggccatggtcggcatttttgacagcaggcggaacgcggcaatttcacgatgacgaggattgttaacatccagcgagtcgtgatagaacgctgccagcgcgccggtaataccacacatgactgccattggatgcgagtcgcgacggaaagcatggaacagacgggtaatctgctcgtggatcatagtatggcgggtcaccgtagttttaaattcgtcatactgttcctgagtcggtttttcaccattcagcaggatgtaacaaacttccaggtagttagaatcggtcgccagctgatcgatcgggaaaccgcggtgcagcaaaataccttcatcaccatcaataaaagtaattttagattcgcaggatgcggttgaagtgaagcctgggtcaaaggtgaacacaccttttgaaccgagagtacggatatcaataacatcttgacccagcgtgcctttcagcacatccagttcaacagctgtgtccccgttgagggtgagttttgcttttgtatcagccatttaaggtctccttagcgccttattgcgtaagactgccggaacttaaatttgccttcgcacatcaacctggctttacccgtttgttatttggctcgccgctctgtgaaagaggggaaaacctgggtacagagctctgggcgcttgcaggtaaaggatctattgatgacgaataaatggcgaatcaagtacttagcaatccgaattattaaacttgtctaccactaataactgtcccgaatgaattggtcaatacttccacactgttacataagttaatcttaggtgaaataccgacttcataacttttacgcattatatgctttttctggtaatgtttgtaacaactttgttgaatgattgtcaaattagatgattaaaaattaaataaatgttgttatcgtgacgcggatcactgttcgggataaaacccgacaaactatatgtaggttaattgtaatgattttgtgaacggcctatactgccgccaggtctccggaacaccctgcaatcccgagccacccagcgttgtaacgtgtcgttttcgcatctggaagcagtgttttgcatgacgcgcagttatagaaaggacgctgtctgacccgcaagcagaccggaggaaggaaatcccgacgtctcctggtaacagaaagttaacctctgtgcccgtagtccccagggaataataagaacagcatgtgggcgttattcatgataagaaatgtgaaaaaacaaagacctgttaatctggacctacagaccatccggttccccgtcacggcgatagcgtccattctccatcgcgtttccggtgtgatcacctttgttgcagtgggcatcctgctgtggcttctgggtaccagcctctcttcccctgaaggtttcgagcaagcttccgcgattatgggcagcttcttcgtcaaatttatcatgtggggcatccttaccgctctggcatatcacgtcgtcgtaggtattcgccacatgatgatggattttggctatctggaagaaacattcgaagcgggtaaacgctccgccaaaatctcctttgttattactgtcgtgctttcacttctcgcaggagtcctcgtatggtaagcaacgcctccgcattaggacgcaatggcgtacatgatttcatcctcgttcgtgctaccgctatcgtcctgacgctctacatcatttatatggtcggttttttcgctaccagtggcgagctgacatatgaagtctggattggtttcttcgcctctgcgttcaccaaagtgttcaccctgctggcgctgttttctatcttgatccatgcctggatcggcatgtggcaggtgttgaccgactacgttaaaccgctggccttgcgcctgatgctgcaactggtgattgtcgttgcactggtggtttacgtgatttatggattcgttgtggtgtggggtgtgtgatgaaattgccagtcagagaatttgatgcagttgtgattggtgctggcggcgcaggtatgcgcgcggcgctgcaaatttcccagagtggccagacctgtgcgctgctctctaaagtcttcccgacccgttcccataccgtttctgcgcaaggtggtattaccgttgcgctgggtaatacccatgaagataactgggaatggcatatgtacgacaccgtaaaagggtcggactatatcggtgaccaggacgcaattgaatatatgtgtaaaactgggccggaagcgattctggaactggaacatatgggcctgccgttctcgcgtcttgatgatggtcgtatctatcaacgtccgtttggcggtcagtcgaaaaacttcggcggcgagcaggcggcacgtactgcggcggctgccgaccgtaccggtcacgcactgttgcacaccctttatcagcagaacctgaaaaaccacaccaccattttctccgagtggtatgcgctggatctggtgaaaaaccaggatggcgcagtggtcggttgtaccgcactgtgcatcgaaactggtgaagtggtttactttaaagctcgcgcgacagtgctggcgactggcggggcagggcgtatttatcagtccaccactaacgcccacattaacactggcgacggtgtcggcatggctatccgtgcaggcgtaccggtacaggatatggaaatgtggcagttccacccgaccggtattgccggtgcgggcgtactggtcaccgaaggttgccgtggtgaaggcggttatctgctgaacaaacatggcgaacgctttatggagcgttatgcgccgaacgccaaagacctggcgggccgtgacgtggtggcgcgttccatcatgatcgaaatccgtgaaggccgcggctgtgatggtccgtgggggccacacgcaaaactgaaacttgaccatctggggaaagaagttctcgaatcccgtctgccgggtattctggaactctcccgtaccttcgctcacgtcgatccggtgaaagagccgattccggttatcccaacctgtcactacatgatgggcggtattccgaccaaagtgaccggtcaggcgctgacggtgaatgagaaaggcgaagatgtggttgttccggggctgtttgccgttggtgaaatcgcttgtgtatcggtacacggcgctaaccgtctgggcggcaactcgctgctggacctggtcgtatttggtcgtgcggcaggtctgcatctgcaagagtctatcgccgagcagggcgcactgcgcgatgccagcgagtctgatgtagaagcgtctctggatcgcctgaaccgctggaacaataaccgtaacggtgaagatccggtggcgatccgtaaagcactgcaagaatgtatgcagcataacttctcggtcttccgtgaaggtgatgcgatggcgaaagggcttgagcagttgaaagttatccgcgagcgtctgaaaaatgcccgtctggatgacacttccagcgagttcaacacccagcgcgttgagtgcctggaactggataacctgatggaaacggcgtatgcaacggctgtttctgccaacttccgtaccgaaagccgtggcgcgcatagccgcttcgacttcccggatcgcgatgatgaaaactggctgtgccactccctgtatctgccagagtcggaatccatgacgcgccgaagcgtcaacatggaaccgaaactgcgcccggcattcccgccgaagattcgtacttactaatgcggagacaggaaaatgagactcgagttttcaatttatcgctataacccggatgttgatgatgctccgcgtatgcaggattacaccctggaagcggaagaaggtcgcgacatgatgctgctggatgcgcttattcagctgaaagagaaagatcccagcctgtcgttccgccgctcctgccgtgaaggtgtgtgcggttccgacggtctgaacatgaacggtaagaatggtctggcctgtattactccgatttcggcactcaaccagccgggcaagaagattgtgattcgcccgctgccaggtttaccggtgatccgcgatttggtggtagacatgggacaattctatgcgcaatatgagaaaattaagccttacctgttgaataatggacaaaatccgccagctcgcgagcatttacagatgccagagcagcgcgaaaaactcgacgggttgtatgaatgtattctctgcgcatgttgttcaacctcttgtccgtctttctggtggaatcccgataagtttatcggcccggcaggcttgttagcggcatatcgtttcctgatcgatagccgtgataccgagactgacagccgcctcgacggtttgagcgatgcattcagtgtattccgctgtcacagcatcatgaactgcgtcagtgtatgtccgaaggggctgaacccgacgcgcgccatcggccatatcaagtcgatgttgttgcaacgtaatgcgtaaacccaggcctgataagacgcgcaagcgtcgcatcaggcaaccagtgccggatgcggcgtgaacgccttatccggcctacaaaagaaatgcagaaaccgtaggcctgataagacgcacaagcgtcgcatcaggcaaccagtgccggatgcggcgtgaacgccttatccggcctacaaaagaaatgcagaaaccgtaggcctgataagacgcgcaagcgtcgcatcaggcaaccagtgccggatgcggcgtgaacgccttatccggcctacaaaagaaatgcagaaaccgtaggcctgataagacgcgcaagcgtcgcatcaggcaaacagcgccggatgcggcgtgaatgccttatccggcctacaaaagaaatgcaggaaatctttaaaaactgcccctgacactaagacagtttttaaaggttccttagcggacgcagaaaacacgacaagtccgcaacaagtgaaccccggcacgcacatcagatatgaaatgtgcgtggtagtatccacggcgaagtaagcataaaaaagatgcttaagggatcacgatgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgaactgctggaagcactcaagcaaacctactgcggcccgattggtgccgagtatatgcacattaccagcactgaagaaaaacgctggatccaacagcgtattgagtctggtcgcgcgactttcaatagcgaagagaaaaaacgcttcttaagcgaactgaccgccgctgaaggccttgaacgttaccttggcgcaaaattccctggcgcaaaacgcttctcgctggaaggcggtgacgcgttaatcccgatgcttaaagagatgatccgccacgctggcaacagcggcacacgcgaagtggttctcgggatggcgcaccgtggtcgtctgaacgtgctggtgaacgtgctgggtaaaaaaccgcaagacttgttcgacgagtttgccggtaaacataaagaacacctcggcacgggcgacgtgaaataccacatgggcttctcgtctgacttccagaccgatggcggcctggtgcacctggcgctggcgtttaacccgtctcaccttgagattgtaagcccggtcgttatcggttctgttcgtgcccgtctggacagacttgatgagccgagcagcaacaaagtgctgccaatcaccattcatggtgacgccgcagtgaccgggcagggcgtagttcaggaaaccctgaacatgtcgaaagcgcgtggttatgaagttggcggtacggtacgtatcgttatcaacaaccaggttggcttcaccacctctaacccgctggatgcccgttcgacgccgtactgtactgatatcggtaagatggttcaggcaccgattttccacgttaatgcggatgatccggaagccgttgcctttgttacccgtctggcgctcgatttccgtaacacctttaaacgtgatgtcttcatcgacctggtatgctaccgccgtcacggccacaacgaagccgacgagccgagcgcaacccagccgctgatgtatcagaaaatcaaaaaacatccgacgccgcgcaaaatctacgctgacaagctggagcaggaaaaagtcgcgacgctggaagatgccaccgagatggttaacctgtaccgcgatgcgctggatgctggcgattgcgttgtagcagagtggcgtccgatgaacatgcactctttcacctggtcgccgtacctcaaccacgaatgggacgaagagtacccgaacaaagttgagatgaagcgcctgcaggaactggctaaacgcatcagcacggtgccggaagcagttgaaatgcagtctcgcgttgccaagatttatggcgatcgccaggcgatggcagccggtgagaaactgttcgactggggcggcgcggaaaacctcgcttacgccacgttggttgacgaaggcattccggttcgcctgtcgggtgaagactccggtcgcggtaccttcttccaccgccacgcggtgatccacaaccagtctaacggttccacttacacgccgctgcaacatatccataacggccagggcgcgttccgcgtctgggactctgtactgtctgaagaagccgtactggcgtttgaatacggttatgccaccgcagaaccacgcaccctgaccatctgggaagcacagttcggtgacttcgccaacggtgcacaggtggttatcgaccagttcatctcctctggcgaacagaaatggggccggatgtgtggcctggtgatgttgctgccgcacggttacgaagggcaggggccggagcactcctccgcgcgtctggaacgttatctgcaactttgcgctgagcaaaacatgcaggtttgcgtaccttctaccccggcacaggtttaccacatgctgcgtcgtcaggcgttgcgcgggatgcgtcgtccactggtcgtgatgtcgccgaaatccctgctgcgtcatccgctggcggtatccagcctcgaagaactggcgaacggcaccttcctgccagccatcggtgaaatcgacgagcttgatccgaagggcgtgaagcgcgtagtgatgtgttctggtaaggtttattacgacctgctggaacaacgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccagcctccgcctctccggcggtagggtatatgtccgttcaccagaaacagcaacaagatctggttaatgacgcgctgaacgtcgaataaataaaggatacacaatgagtagcgtagatattctggtccctgacctgcctgaatccgtagccgatgccaccgtcgcaacctggcataaaaaacccggcgacgcagtcgtacgtgatgaagtgctggtagaaatcgaaactgacaaagtggtactggaagtaccggcatcagcagacggcattctggatgcggttctggaagatgaaggtacaacggtaacgtctcgtcagatccttggtcgcctgcgtgaaggcaacagcgcgggtaaagaaaccagcgccaaatctgaagagaaagcgtccactccggcgcaacgccagcaggcgtctctggaagagcaaaacaacgatgcgttaagcccggcgatccgtcgcctgctggctgaacataacctcgacgccagcgctattaaaggcacgggtgtgggtggtcgtctgacccgtgaagatgtggaaaaacatctggcgaaagccccggcgaaagagtctgctccggcagcgcctgctccggcggcgcaaccggccctggctgcacgtagcgaaaaacgtgtgccgatgactcgcctgcgtaagcgtgtggcagagcgtctgctggaagcgaaaaactccaccgccatgctgaccacgttcaacgaagtcaacatgaagccgattatggatctgcgtaagcagtacggtgaagcgtttgaaaaacgccacggcatccgtctgggctttatgtccttctacgtgaaagcggtggttgaagccctgaaacgttacccggaagtgaatgcgtctatcgacggtgatgatgtggtctaccacaactatttcgacgtcagtatggcggtttctacgccgcgcggtctggtgacgccggttctgcgtgatgtcgataccctcggcatggcagacatcgagaagaaaatcaaagagctggctgttaaaggccgtgacggcaagctgacggttgaagatctgaccggtggtaacttcaccatcaccaacggtggtgtgttcggttccctgatgtcaacgcctatcatcaacccaccgcagagcgcaattctgggtatgcacgctatcaaagatcgtccgatggcagtgaatggtcaggttgagatcctgccgatgatgtacctggcgctgtcctacgatcaccgtttgatcgatggtcgcgaatccgtgggcttccttgtaacgatcaaagagttgctggaagatccgacgcgtctgctgctggacgtgtagtagtttaagcttcacctgcactgtagaccgacgtggatagggtgtcggtctacggtttaaaagataacgattactgaaggatggacagaacacatgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgcgtggtctttatggcctccaccgaaggcggcgtggaaattgaaaaagtggcggaagaaactccgcacctgatccacaaagttgcgcttgatccgctgactggcccgatgccgtatcagggacgcgaactggcgtttaaactgggtctggaaggtaaactggttcagcagttcaccaaaatcttcatgggtctggcgaccattttcctggagcgcgacctggcgctgatcgaaatcaacccgctggttattaccaaacagggcgatctgatttgcctcgacggcaaactgggcgctgatggcaacgcactgttccgccagcctgatctgcgtgaaatgcgtgaccagtcgcaggaagatccgcgtgaagcacaggctgcacagtgggaactgaactacgttgcgctggacggtaacatcggttgtatggttaacggcgcaggtctggcaatgggtacgatggacatcgttaaactgcacggcggcgaaccggctaacttcctggacgttggcggcggcgcaaccaaagaacgtgtaaccgaagcgttcaaaatcatcctctctgacgacaaagtgaaagctgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggtgcgaagaaactggctgacagcggcctgaatattattgcagcaaaaggtctgacggatgcagctcagcaggttgttgccgcagtggaggggaaataatgtccattttaattgataaaaacaccaaggttatctgccagggctttaccggtagccaggggactttccactcagaacaggctattgcatacggcactaaaatggttggcggcgtaaccccaggtaaaggcggcaccacccacctcggcctgccggtgttcaacaccgtgcgtgaagctgttgctgctactggcgctaccgcttctgttatctacgtaccagcaccgttctgcaaagactccattctggaagccatcgatgcaggcatcaaactgattatcaccatcactgaaggcatcccgacgctggatatgctgaccgtgaaagtgaaactggatgaagcaggcgttcgtatgatcggcccgaactgcccaggcgttatcaccccgggggaatgcaaaatcggtatccagccgggtcacattcacaaaccaggtaaagtgggtatcgtttcccgttccggtacgctgacctatgaagcggttaaacagaccacggattacggtttcggtcagtcgacctgtgttggtatcggcggcgacccgatccctggctctaactttatcgatatcctcgaaatgttcgaaaaagatccgcagaccgaagcgatcgtgatgatcggtgagatcggcggtagcgctgaagaagaagcagcggcgtacatcaaggaacacgttaccaagccagttgtgggttacatcgctggtgtgactgcgccgaaaggcaaacgtatgggtcacgcaggtgcgatcattgccggtggtaaagggactgcggatgagaaattcgctgctctggaagccgcaggcgtgaaaaccgttcgcagcctggcggatatcggtgaagcactgaaaactgttctgaaataaatatctgtaataagaaatagccctcgccgcttccccctacaggaagggcgaagggctgtcggtttcgacatggttggccatcttatgatggccttttttattcgggcactaatctgaaaagtttgcccactgcttttctcccatcctctgcgcaataatgcccggcaaaatatcccctctccgttctgtaaaagcatttatacaagaagaaaattgttctgccggttgctctggccctgatgggtgtaaattcgaacgtttatgcggccgatgtaaatatcgatattttaagtgcgacagtgaaagataaacgcattgagggagtatcggtgacgctgcaacgcaatggcgcacaatctgtttctggaaccacaaatgcatcgggcagcgttaatctgggttctacatttgctgatgatcaagatgctttattgatcgtcaaaaaagagggctattctaatctggtggtcaaatgttcgtgtgctggcatgacttatgctatcagtccggcaatgactagtctggatggcatgcgtgtagttttgagctggggcgaaaagccttttgatcttgattcacatttgctcttccctggtggacatatctattttgatagtaaagaggggactgatgccaatctggatgttgatgatacggatagctatggaccagaaactgtcactatcagcaaaaagcattttggtgaaagttacatctatgccgtgcaggactatagcaataaagggctgcccaacagtaattatctctctgccagtaaggcaaaagtgtttgtttatgtagggagctccctggtgcgtagttatagtgtccctgctggaaaacgagggaacatctggaccgtgtttaaactcaatccaaacggcgagtttgaagatatcaactctgttaccagcgccaattttaacgacaccacattaggcgtcagggatttagccactgtgataatgcctgcgacgggttcttcaactccggcttcacctgcgatgcaaaacagtggagatactcaactggcaagaaaatataatcgtgaaggcgaagctgtttacaaaaccggtcaacttgagcaagccattcaactcttccaacaggcaacagaattagacggcaattacggacaggcatttagtaacctggggctggcgtatcagaaaaatggcaacatcgcggaagcaatttgggcaaatcgtaaagcgatctcgttagccagtggagcaaatgcggcgacaacgcgcgctaactcctattataacattgccaaaatttatgaaactgctggacaggacgctgatgcattgcagcattatcaactcgctcttcacgatgccattttataaaaatgaaagtggaatcatattttttaattttatatgcttgcttgtttttctggtcaagttatccatcattcactgttttattatcttaaggatgatggaaatagaaggttttttaatgataataaaacatattcttatgttatttaatcacgaattttttaatatgattatgtatcaatacgttatattacccgatgtgctactgaattatcgactattactttaatatttagtgatcgtaaacatggttctccagattactaaatttctggcatcttacaatatcatcatcttcaaatagttaaattaagattatggcactgccaaaacagataaattgaagcagtctggtagatattgcagaacaaccttgattccaacggcgaaatcatgtttatcctccaggttgccgcccatatggagctgaatatcattcagtccacgcttgatgagttgatatcgctatatccatagacagggtagctttttacacgagagtgtccggtgttttctaacggctggcaatcattccgttttgttgtttcgtatcactgctataacaatttctcttgaatttcaatctttgagcgaatcattgaatacagatcgggaaatattaataccatatatattttattttgaaaatccttgttccatctgactatacctaaggtatctatttcttcttgtgattattaccaatgaaacaataagtgacggatttacagtacgttgctcataaagacaacaatcaattaacgttgataaaaatatgttatgtaaaatggcaataaagtagctactctaactaattagtattataaaaagtcgataaagcggctctgttaaataaaatactggttttttatctatatatttccatgtgggtaattttactgtgctattttgttacaataaattaacaataaagttaccagtggctcatgattcacacataattaacatatgtggttgattttgatataaatcaatttttaattcttgaaaaaaatctgcaaaacacgataaattgttgtagatcaaattggtgagatcgtgacaatttcgctataaattgatcactgtcgaaaaatgcaaatttgctcaataaaaacctgtttattgtaaggattttgcggcgtaatataattacggaatcaatttggtttattcattaacacatttgtaacttttttatcattgtcttttcctcttttgatgaaatggcaacgatagaggcgagcaaataattttgtattggggcatgcgtgtgaccctttctaacggggttcactctcggagtcttcatgcgatgagcaaggagtcataatgttagatatagtcgaactgtcgcgcttacagtttgccttgaccgcgatgtaccacttcctttttgtgccactgacgctcggtatggcgttcctgctggccattatggaaacggtctacgtcctttccggcaaacagatttataaagatatgaccaagttctggggcaagttgtttggtatcaactttgctctgggtgtggctaccggtctgaccatggagttccagttcgggactaactggtcttactattcccactatgtaggggatatcttcggtgcgccgctggcaatcgaaggtctgatggccttcttcctcgaatccacctttgtaggtctgttcttcttcggttgggatcgtctgggtaaagttcagcatatgtgtgtcacctggctggtggcgctcggttcaaacctgtccgcactgtggattctggttgcaaacggctggatgcaaaacccaatcgcgtccgatttcaactttgaaactatgcgtatggagatggtgagcttctccgagctggtgcttaacccggttgctcaggtgaaattcgttcacaccgtagcttctggttatgtgactggcgcaatgttcatcctcggtatcagcgcatggtatatgctgaaaggtcgtgacttcgccttcgctaaacgctcctttgctatcgctgccagcttcggtatggctgccgttctgtctgttattgttctgggtgatgaatccggctacgaaatgggcgacgtgcagaaaaccaaactggctgctatcgaagccgagtgggaaacgcaacctgcacctgctgcctttactctgttcggcattcctgatcaggaagaggaaacgaacaaatttgcgatccagatcccttacgcgctgggcatcattgcaacgcgttccgtggatactccagttatcggtctgaaagaactgatggtgcagcatgaagaacgcattcgtaacgggatgaaggcgtactctctgctcgaacaactgcgttctggttctactgaccaggccgttcgtgaccagttcaatagcatgaagaaagatctcggttacggtctgctgctgaaacgctatacgccaaacgtggctgatgcgactgaagctcagattcaacaggcaaccaaagactccattccgcgtgtagcgccgctgtactttgcgttccgtatcatggtggcgtgtggcttcctgctgctggcaatcatcgcgctctctttctggagtgtcatccgaaaccgcattggcgagaaaaaatggctgctgcgcgccgcgctgtacggtattccgctgccgtggattgctgtagaagcgggctggttcgtggctgaatatggccgccaaccgtgggctatcggtgaagtgctgccgacagctgtggcgaactcgtcactgaccgcaggcgatctcatcttctcgatggtgctgatttgcggcctgtataccctgttcctggtggcagaattgttcttaatgttcaagtttgcacgcctcggcccaagcagcctgaaaaccggtcgctatcactttgagcagtcttccacgactactcagccggcacgctaagacaggagtcgtcaaatgatcgattatgaagtattgcgttttatctggtggctgctggttggcgttctgctaattggttttgcagtcactgacggtttcgacatgggggtgggcatgctcacccgtttcctcggtcgtaacgacaccgagcgtcgaattatgattaactccatcgcaccacactgggacggtaaccaggtttggctgatcaccgcaggcggcgcactgtttgctgcctggccgatggtctatgccgctgcgttctccggcttctatgtggcgatgatcctcgtactggcgtctttgttcttccgtccggtcggttttgactaccgctctaagattgaagaaacccgctggcgtaacatgtgggactggggcatcttcattggtagcttcgttccgccgctggtgattggtgtagcgttcggtaacctgttgcagggcgtaccattcaacgttgatgaatatctgcgtctgtactacaccggtaacttcttccagctgcttaacccgttcggcctgctggcaggtgtggtgagcgtagggatgatcattactcagggcgcaacctatctgcaaatgcgtaccgtgggcgaactacacctgcgtacccgtgcaacggctcaggtggcggcactggtgacgctggtctgcttcgcactggctggcgtatgggtgatgtacggtatcgatggttatgtcgtgaaatcgacaatggaccattacgcagcctccaacccgctgaataaagaagtggttcgtgaagctggcgcatggctggttaacttcaacaacacgccaattctgtgggctattccggcactgggtgtggttctgccgctgctgaccatcctgactgcacgtatggataaagccgcgtgggcgtttgtgttctcctccctgacgctggcctgcatcatcctgactgccggtatcgcaatgttcccgtttgtgatgccgtccagcaccatgatgaacgcaagtctgacaatgtgggatgcaacttccagccagctgacgcttaacgtcatgacctgggttgcggtggttctggtaccgatcattctgctctacaccgcctggtgttactggaaaatgttcggtcgtatcaccaaagaagatattgaacgtaacacccactctctgtactaagtaaggagctaaaaatgtggtatttcgcatggattctgggaacgcttcttgcctgttcgtttggggtaatcaccgcgctggcgcttgagcacgtcgaatcaggcaaagccggtcaagaagacatctgatgagtaagattatcgcaaccttgtatgcggtaatggacaagcgccccctgcgggcgctttccttcgtgatggcacttctgttagcaggatgtatgttttgggacccatcacgtttcgccgcgaagaccagtgaactggaaatctggcatggtttactgctgatgtgggccgtctgtgctggtgtgattcacggcgtgggctttcgtccgcagaaggttctctggcaagggattttttgcccattgcttgccgatattgttctcattgtcgggctgattttcttcttcttttaaatcagaattctctttaaaaatttatgggccgagtcaggcccataaatttttacgctcccttaacttgccctcattcccaaacctcaatcgcgcgcgtatagtagcagcgtttaaaagctctaacttttgttgcattaccgggatgtaaagtgaatacaacgctgtttcgatggccggttcgcgtctactatgaagataccgatgccggtggtgtggtgtaccacgccagttacgtcgctttttatgaaagagcacgcacagagatgctgcgtcatcatcatttcagtcaacaggcgctgatggctgaacgcgttgcctttgtggtacgtaaaatgacggtggaatattacgcacctgcgcggctcgacgatatgctcgaaatacagactgaaataacatcaatgcgtggcacctctttggttttcacgcaacgtattgtcaacgccgagaatactttgttgaatgaagcagaggttctggttgtttgcgttgacccactcaaaatgaagcctcgtgcgcttcccaagtctattgtcgcggagtttaagcagtgactgacatgaatatccttgatttgttcctgaaggctagccttctggttaaacttatcatgttgattttgattggtttttcaatcgcatcctgggccattattatccagcggacccgtattcttaacgcagcggcgcgcgaagccgaagcgtttgaagataaattctggtctggaatcgaactctctcgcctctatcaagagagccaggggaaacgggataatctgagcggttcggaacaaatcttttacagcggcttcaaagagtttgtgcgcctgcatcgtgccaatagccatgcgccggaagccgtagtggaaggggcgtcgcgtgcgatgcgtatttccatgaatcgtgaacttgaaaatctggaaacgcacattccgttcctcggtacggttggctccatcagcccgtatattggtctgtttggtacggtctgggggatcatgcacgcctttatcgccctcggggcggtaaaacaagcaacactgcaaatggttgcgcccggtatcgcagaagcgttgattgcgacggcaattggtttgttcgccgcaattccggcggtaatggcttataaccgcctaaaccagcgcgtaaacaaactggaactgaattacgacaactttatggaagagtttaccgcgattctgcaccgccaggcgtttaccgttagcgagagcaacaaggggtaagccatggccagagcgcgtggacgaggtcgtcgcgatctcaagtccgaaatcaacattgtaccgttgctggacgtactgctggtgctgttgctgatctttatggcgacagcgcccatcatcacccagagcgtggaggtcgatctgccagacgctactgaatcacaggcggtgagcagtaacgataatccgccagtgattgttgaagtgtctggtattggtcagtacaccgtggtggttgagaaagatcgtctggagcgtttaccaccagagcaggtggtggcggaagtgtccagccgtttcaaggccaacccgaaaacggtctttctgatcggtggcgcaaaagatgtgccttacgatgaaataattaaagcactgaacttgttacatagtgcgggtgtaaaatcggttggtttaatgacgcagcctatctaaacatctgcgtttcccttgcttgaaagagagcgggtaacaggcgaacagtttttggaaaccgagagtgtcaaaggcaaccgaacaaaacgacaagctcaagcgggcgataattatttcagcagtgctgcatgtcatcttatttgcggcgctgatctggagttcgttcgatgagaatatagaagcttcagccggaggcggcggtggttcgtccatcgacgctgtcatggttgattcaggtgcggtagttgaacagtacaaacgtatgcaaagccaggaatcaagcgcgaagcgttctgatgagcagcgcaagatgaaggagcagcaggctgctgaagaactgcgtgagaaacaagcggctgaacaggaacgcctgaagcaacttgagaaagagcggttagcggctcaggagcagaaaaagcaggctgaagaagccgcaaaacaggccgagttaaagcagaagcaagcggaagaggcggcagcgaaagcggcggcagatgctaaagcgaaggccgaagcggatgctaaagctgcggaagaagcagcgaagaaagcggcggcagacgcgaagaaaaaagcagaagcagaagccgccaaagccgcagtcgaagcgcagaaaaaagccgaggctgctgctgcggcgctgaagaagaaagctgaagcggcagaagcagctgcagctgaagcaagaaagaaagcggcaaccgaagctgctgaaaaagccaaggcagaagctgagaagaaagcggctgctgaaaaggctgcagctgataagaaagcggcagcagagaaagcggcagccgacaaaaaagcagcagaaaaagcggctgctgaaaaggcagcagctgataagaaagcagcggcagaaaaagccgccgcagacaaaaaagcggcagcggcaaaagcagcagctgaaaaagccgctgcagcaaaagctgccgcagaggcagatgatattttcggtgagctaagctctggtaagaatgcaccgaaaacggggggaggggcgaaagggaacaatgcttcgcctgccgggagtggtaatactaaaaacaatggcgcatcaggggccgatatcaataactatgccgggcagattaaatctgctatcgaaagtaagttctatgacgcatcgtcctatgcaggcaaaacctgtacgctgcgcataaaactggcacccgatggtatgttactggatatcaaacctgaaggtggcgatcccgcactttgtcaagctgcgttggcagcagctaaacttgcgaagatcccgaaaccaccaagccaggcagtatatgaagtgttcaaaaacgcgccattggacttcaaaccgtaatcgcgatgttgactgttccgacggtcaacatcaggcaccggttgccacggggttctggtagttttgtgtattttagtttgttaacattctgctaaattatcgtgggccatcggtccagataagggagatatgatgaagcaggcattacgagtagcatttggttttctcatactgtgggcatcagttctgcatgctgaagtccgcattgtgatcgacagcggtgtagattccggtcgtcctattggtgttgttcctttccagtgggcggggcctggtgcggcacctgaagatattggcggcatcgttgctgctgacttgcgtaacagcggtaaatttaatccgttagatcgtgctcgtctgccacagcagccgggtagtgcgcaggaagtacaaccagctgcatggtccgcgctgggcattgacgctgtggttgtcggtcaggtcactccgaatccggatggttcttacaatgttgcttatcaacttgttgacactggcggcgcaccgggtactgtacttgctcagaactcgtacaaagtgaacaagcagtggctgcgttatgctggtcataccgccagtgacgaagtatttgaaaaactgaccggtattaaaggtgcgttccgtacccgtattgcctacgttgttcagactaacggcggtcagttcccgtatgaactgcgcgtatctgactatgacggttacaaccagtttgtcgttcaccgttcaccgcaaccgctgatgtctccggcgtggtcaccagacggttctaaactggcttatgtgaccttcgaaagcggtcgttccgcgctggttattcagacgctggcaaatggcgctgtacgtcaggtggcttcattcccgcgtcacaacggtgcacctgcattctcgccagacggcagcaaactggcattcgccttgtcgaaaaccggtagcctgaacctgtacgtaatggatttggcttctggtcagatccgccaggtaactgatggtcgcagtaacaataccgaaccgacctggttcccggacagccagaacctggcatttacttctgaccaggccggtcgtccgcaggtttataaagtgaatatcaacggcggtgcgccacaacgtattacctgggaaggttcgcagaaccaggatgcggatgtcagcagcgacggtaaatttatggtaatggtcagctccaacggtgggcagcagcacattgccaaacaagatctggcaacgggaggcgtacaagttctgtcgtccacgttcctggatgaaacgccaagtctggcacctaacggcactatggtaatctacagctcttctcaggggatgggatccgtgctgaatttggtttctacagatgggcgtttcaaagcgcgtcttccggcaactgatggacaggtcaaattccctgcctggtcgccgtatctgtgataataattaattgaatagtaaaggaatcattgaaatgcaactgaacaaagtgctgaaagggctgatgattgctctgcctgttatggcaattgcggcatgttcttccaacaagaacgccagcaatgacggcagcgaaggcatgctgggtgccggcactggtatggatgcgaacggcggcaacggcaacatgtcttccgaagagcaggctcgtctgcaaatgcaacagctgcagcagaacaacatcgtttacttcgatctggacaagtacgatatccgttctgacttcgctcaaatgctggatgcacacgcaaacttcctgcgtagcaacccgtcttacaaagtcaccgtagaaggtcacgcggacgaacgtggtactccggaatacaacatctccctgggtgaacgtcgtgcgaacgctgttaagatgtatctgcagggtaaaggcgtttctgctgaccagatctccatcgtttcttacggtaaagaaaaacctgcagtactgggtcatgacgaagcggcgtatgccaaaaaccgtcgtgcggtactggtttactaagagaattgcatgagcagtaacttcagacatcaactattgagtctgtcgttactggttggtatagcggccccttgggccgcttttgctcaggcaccaatcagtagtgtcggctcaggctcggtcgaagaccgcgtcactcaacttgagcgtatttctaatgctcacagccagcttttaacccaactccagcaacaactctctgataatcaatccgatattgattccctgcgtggtcagattcaggaaaatcagtatcaactgaatcaggtcgtggagcggcaaaagcagatcctgttgcagatcgacagcctcagcagcggtggtgcagcggcgcactcaaccagcggcgatcaaagcggtgtggcggcatcaacgacgccgacagctgatgctggtactgcgaatgctggcgcgccggtgaaaagcggtgatgcaaacacggattacaatgcagctattgcgctggtgcaggataaatcccgccaggatgacgcaatggtggcatttcagaatttcatcaaaaattaccctgattcaacttacctgccaaacgccaattattggctgggtcagttaaactacaacaagggtaaaaaagatgatgcggcgtattattttgcttcggtagtgaaaaactatccgaagtcaccgaaggctgcagatgcgatgtttaaagtcggcgtcatcatgcaggacaaaggtgacaccgcaaaagcgaaagccgtataccagcaggttatcagtaaataccctggtactgatggcgctaaacaggcgcaaaaacgtctgaacgcgatgtaatgcataacacacgaccagaagtcgcattatttctggtcgtgtcgtgcgaatcataagcagttgagtgatctacatcgaaatttttgttgcgctcaagtctgaaatcagtaatatatgccgccgttgccacgggatatcaaacaaaccgaaagcaacgaaaaagtgggtcgttagctcagttggtagagcagttgacttttaatcaattggtcgcaggttcgaatcctgcacgacccaccactaacatagttagttgtagtatccagcgtagtatcgggtgattagctcagctgggagagcacctcccttacaaggagggggtcggcggttcgatcccgtcatcacccaccaccgggtcgttagctcagttggtagagcagttgacttttaatcaattggtcgcaggttcgaatcctgcacgacccaccactgattacggtgggttcggtggaagtagtttgtagtatccagcgcagtatcgggtgattagctcagctgggagagcacctcccttacaaggagggggtcggcggttcgatcccgtcatcacccaccactcgggtcgttagctcagttggtagagcagttgacttttaatcaattggtcgcaggttcgaatcctgcacgacccaccaattttaaacattggttccgagtagaaatctttcaggtaacacccgtatgggtcgttagctcagttggtagagcagttgacttttaatcaattggtcgcaggttcgaatcctgcacgacccaccatcctgaatgattaaagcagcataatcccgcaaggggtcgttagctcagttggtagagcagttgacttttaatcaattggtcgcaggttcgaatcctgcacgacccaccaatgcaaaaaagcgccctaaaggcgcttttttgctattcaggcatctctcaatttcaattcttgaccctgatgacatactccgcgcttgctgcgtaaacaactctacgtcgggggaataagacgcaaagtgtggcattcggcatctcatacgtaattcgagtgacttttccccaccattcgactatcttgtttagcatataaaacaaattacgccgataatagcgaatatcacgcttaagtcggttttaacgttaagcctgtaaaacgagatggtaagatgagcgtgatgtttgatccagacacggcgatttatcctttccccccgaagccgacgccgttaagcattgatgaaaaagcgtattaccgcgagaagataaaacgtctactaaaagaacgtaatgcggtgatggttgcccactactataccgatcccgaaattcaacaactggcagaagaaaccggtggctgtatttctgattctctggaaatggcgcgcttcggtgcaaagcatcccgcttctacgttgttagttgctggggtgagatttatgggagaaaccgccaaaattctcagtccggaaaaaacaattctgatgccgacacttcaggctgaatgttcactggatctcggctgccctgttgaagaatttaacgcattttgcgatgcccatcccgatcgtactgtcgtcgtctacgccaacacttctgctgcggtaaaagcgcgcgcagattgggtggtaacttcaagcattgccgtcgaacttattgatcatctggatagtttaggtgaaaaaatcatctgggcacctgacaaacatctggggtgttacgtgcaaaaacagacgggcgcagacattttatgctggcagggtgcctgcattgtgcatgatgagtttaagactcaggcgttaacccgcttgcaagaagaatacccggatgctgccatactggtgcatccagaatcaccgcaagctattgtagagatggcggatgcggtcggttccaccagtcaactgatcgctgctgcgaaaacattgccacatcagcggcttatcgtggcaaccgatcggggcattttctacaaaatgcagcaggcggtgccagataaagagttactggaagcaccaaccgcgggtgagggcgcaacctgtcgcagctgcgcgcattgcccgtggatggccatgaatggccttcaggccatcgcagaggcattagaactggaaggaagcaatcacgaggtttatgttgatgaaaggctgctagagagggcgctggtgccgctcaatcgtatgctggattttgcggctacactacgtggataattgataataaggcgtcacattacgctttgggggaacgatggatttttttagtgtgcagaatatcctggtacatataccaataggggcaggcggttatgatctctcatggatcgaagcggtaggcacgatcgccgggttgctgtgtattggccttgccagtctggagaagatcagtaactacttctttggcctgatcaacgtcaccttgtttggcattattttctttcagattcagctgtatgccagcctgctattacaggtgtttttctttgccgcgaatatttacggctggtatgcgtggtcgcgacaaaccagtcagaacgaggcggagttgaaaattcgctggttgccattgccgaaggcgctaagctggttggcggtttgcgttgtttcgattggtctgatgacggtatttatcaatccggtgtttgcatttttgacccgcgtggcagtcatgatcatgcaagcattaggattacaggttgcgatgcctgaactacagccggacgctttcccgttctgggattcatgcatgatggtgttatctatcgtggcaatgattctgatgacgcgtaagtatgtggaaaactggctgttgtgggtgattattaacgtgattagcgtcgttatttttgcacttcagggcgtttacgccatgtctctggagtacatcatcctgacctttattgccctcaacggcagccggatgtggatcaacagcgcacgcgaaagaggttcacgcgcgctgtcccattaatggtgatgatgtgaatggccagacaccccttcattcaggtggcagtctggcccatgacaaggttgatattccatctgaatagtggcgtgctcaatctgatagtgatccatcaggtagtgttggatctgatctaacaaggcatcgtgatcgtgtggcgggatcacctgcacatgcagcgtcatcaccggcttctcgcctaccatccatacatgtacatggtgcacattgcggacttccgggatttcccggcacatacgacgcttcagttcggcgatatccagcgataccggtgcaccttcaagtaattcattcacgctatctttcaacagtcgccacgcgctacgcagaaccagaagcgacaccagtattgagagaatggggtcagcaggtgtccagccggtccagataataatcaacgcggcaataatagccccaaccgaacccagcaggtccccgagcacatgcagtgccgctgctcgcacgttgaggtttttctcttcgctgccgtgatgaagtaaccagaaagaaagtatatttgccagcagcccagccacggcaattgccatcatcatgccgccctcgaccggacgcggagtgcggaagcgttctatcgcctcccagacaatcaaaatagtaatcaccaccagggcgatggcattcacaaacgccgcgagcgtggtcaatcttagccaaccgaaagtgtggcgaatggtgggaggacgacgggaaaattgcactgcgagtagggcgaaaagcagggcggcagtatcggtcaacatatgacccgcatcggccagcaatgccagagaaccggaaagaaaaccaccaatgacttctacgagcataaacccggcagtcacgccgaaagcatacaacaagcgacgagcattattatcttctggcaggtgtgaggaagtgtgtgagtgtgagtgcgccatgacgagtcatcccttaattattctcacttaactttatgacatcatactgcttttagaagggaaaaattaaaagggagagactccgctctcccattattggctatttcgcagggttactgcgtggtaccgtcggttttggtatcgacatcattgttgatgccatcaccggtttggacttttttattgatatccgggcagcgaccatctttgcacatggtgttcttgtgctcttcatctttggtcatgccgtcattgttcattgaagaaccatccggatgcagcattgtgccgccagaaccggtatttaccccgttattgtcgacgttatttggcgcgacattttcacgggcatcaggggctacctggcccgcatcagctgcggcgtttgcctggccgttattgctttgcgctccgctatcggcagccagtgcggcaccgctggcaaggcttagagtggcagtcaaaaatagtgtggccagttttgtcattttcataggatgctcctgttatggtcgttatgtcggataacctcttccaacagtgcatttgcaggtgaatataaggcaatggttatttcagccaggcaaagatacccagcagagaatcttgaaataattaacaaacaaaggagttacagttagaaattgtaggagagatctcgtttttcgcgacaatctggcgtttttcttgctaattccaggattaatccgttcatagtgtaaaaccccgtttacacattctgacggaagatatagattggaagtattgcattcactaagataagtatggcaacactggaacagacatgaattatcagaacgacgatttacgcatcaaagaaatcaaagagttacttcctcctgtcgcattgctggaaaaattccccgctactgaaaatgccgcgaatacggtcgcccatgcccgaaaagcgatccataaaatcctgaaaggtaatgatgatcacctgttggtggtgattggcccatgctcaattcatgatcctgtcgcggctaaagagtatgccgctcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccccacaatatctcgctgacctgatgagctggggcgcaattggcgcacgtactacggaatcgcaggtgcaccgcgaactggcatcagggctttcttgcccggtaggcttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaaagtttaattgtcggatgcgccgtcagagtggcgtatccgattaatcaccggaggcctgataaaacgcgcagcgtcgcatcaggcaatgtgctccattgttagcaacgacaaacaaaaaagccgactcacttgcagtcggctttctcatttttaaacgaatgacgtttacttcgctttaccctggttagcaaccgccgctgctttcgccgcgatctcgtcagcattacccagataatagcgtttcagcggtttgaagttctcgtcaaactcataaaccagcggcacgccggtcgggatattcagctcaagaatctcttcttcgctcatgttatcgagatatttcaccagcgcacgtaacgagttaccgtgtgcggcgatgatgacgcgctcaccgctcttcatacgcggcagaatggtttcattccagtaagggatcacgcggtcaatggtcagcgccaggctttccgtcagcggcagttctttctcgctcagtttcgcgtaacgcggatcgtgacccggataacgctcatcatctttagtcagttccggcggagtcaccgcaaaaccacgacgccactgtttcacctgctcgtcgccatacttttcagcggtttccgctttgttcagaccctgcaacgcaccgtagtgacgttcgttcagtttccaggatttctcaacgggcagccatgcctgatccagttcgtccagcacattccacagggtatgaatagcgcgtttcagcacagaggtgtaagcaaagtcaaagctgtaaccttcctctttcagcagcttacctgctgcttttgcttcgcttacgcctttctcagacagatccacgtcgtaccaaccggtgaaacggttttctttgttccactgactttcgccatgacgaaccagaaccagcttagttacagccatatacttactcctcaaatcatcttttaatgataataattctcattatattgccgtgacgaagcaacagcaatgcttacgcataaccatagcgaaaatagtgtcgcagtgtaaggttgttgtgaatattgagttgcaaatatgtcggtgtttgctggtgatttgaacaatatgaagataaagccctcatgacgagggcttaacattactgagcaataaactgatattccgtcaggctggaatactcttcgccaggacgcaggaagcagtccggttgcggccattcagggtggttcgggctgtccggcagaaattcgctttccagagccagcccttgccagtcggcgtaaggttcggttccccgcgacggtgtgccgccgaggaagttgccggagtagaattgcagagccggagcggtggtgtagaccttcagctgcaatttttcatctgctgaccagacatgcgccgccactttcttgccatcgcctttggcctgtaacaagaacgcgtgatcgtaacctttcactttgcgctgatcgtcgtcggcaagaaactcactggcgatgattttggcgttgcggaaatcaaaagaggttccggcgacagatttcaggccgtcgtgcggaatgcctccttcatcaaccggcagatattcttccgccagaatctgcaacttatgattgcgcacgtcagactgctcgccgtcaagattgaaatagacgtgattagtcatattcaccgggcaaggtttatcaactgtggcgcgataagtaatggagatacggttatcgtcggtcagacgatattgcaccgtcgcgccgagattacccgggaaaccctgatcgccatcatctgaactcagggcaaacagcacctgacgatcgttctggttcacaatctgccagcgacgtttgtcgaacccttccgggccgccgtgcagctggttaacgccctgacttggcgaaagcgtcacggtttcaccgtcaaaggtataacggctattggcgatgcggttggcataacgaccaatagaggcccccagaaacgcggcctgatcctgatagcattccgggctggcacagccgagcagcgcctcgcggacgctgccatcggaaagcggaatacgggctgaaagtaaagtcgcaccccagtccatcagcgtgactaccatccctgcgttgttacgcaaagttaacagtcggtacggctgaccatcgggtgccagtgcgggagtttcgttcagcactgtcctgctccttgtgatggtttacaaacgtaaaaagtctctttaatacctgtttttgcttcatattgttcagcgacagcttgctgtactgcaggcaccagctcttccgggatcagcgcgacgatacagccgccaaatccgccgccggtcatgcgtacgccacctttgtcgccaatcacagctttgacgatttctaccagagtgtcaatttgcggcacggtgatttcgaaatcatcgcgcatagaggcatgagactccgccatcaactcgcccatacgtttcaggtcgccttgctccagtgcgctggcagcttcaacggtgcgggcgttttcagtcaggatatgacgcacgcgtttcgccacgattgggtccagttcatgcgcaacagcgttgaactcttcaatggtgacatcgcgcagagctggctgctggaagaaacgcgcaccggtttcgcactgttcacgacgggtgttgtattcgctgccaaccagggtacgtttgaagttactgttgatgatgacgacagccacacctttgggcatggaaactgctttggtccccagtgagcggcagtcaatcagcaaggcatgatctttcttgccgagtgcggaaattagctgatccatgatcccgcagttacagccaacaaattggttttctgcttcctgaccgttaagcgcgatttgtgcgccgtccagcggcagatgataaagctgctgcaatacggttccgaccgcgacttccagtgaagcggaagaacttaacccggctccctgcggcacattgccgctgatcaccatgtccacaccgccgaagctgttgttacgcagttgcagatgtttcaccacgccacgaacgtagttcgcccattgatagttttcatgcgcgataatgggcgtatcaagggaaaactcgtcgagctgattttcataatcggctgccatcacgcgaactttacggtcatcgcgtggtgcacaactgatcacggtttgataatcaatcgcgcagggcagaacgaaaccgtcgttgtagtcggtgtgttcaccaatcaaattcacgcggccaggcgcctgaatggtgtgagtggcagggtagccaaatgcgttggcaaacagagattgtgttttttctttcagactcatttcttacactccggattcgcgaaaatggatatcgctgactgcgcgcaaacgctctgctgcctgttctgcggtcaggtctcgctgggtttctgccagcatttcataaccaaccataaatttacgtacggtggcggagcgcaacagaggcggataaaagtgcgcgtgcagctgccagtgttgattctcttcgccattaaatggcgcgccgtgccagcccatagagtaggggaaggagcactggaagaggttgtcataacgactggtcagctttttcaacgccagtgccaaatcgctgcgctgggcgtcggtcaaatcggtgatccgtaaaacgtgggctttgggcagcagtagcgtttcgaacggccaggcagcccagtaaggcacgacggctaaccagtgttcggtttcgacaacggtacggctaccgtctgccagctcgcgctgaacataatccaccagcattggtgatttctgttcggcaaaatattctttttgcaggcggtcttcgcgctcagcttcgttaggcaggaagctatttgcccaaatctgtccgtgcggatgcgggttagagcagcccatcgccgcacctttgttttcaaagacctgcacccatgggtatgttttccccagttctgcggtttgctcctgccaggttttgacgatttccgtcaatgccgcaacgctcagttctggcaacgttttactgtgatccggtgaaaagcagatcacccggctggtaccgcgcgcgctctggcaacgcatcagcggatctttgctttctggcgcatctggcgtgtcagacatcaaggccgcaaagtcattagtgaaaacgtaagtcccggtgtaatcggggtttttatcgcctgtcacccgcacattacctgcgcagaggaagcaatctggatcatgcgcaggtaacacctgtttggctggcgtttcctgcgccccctgccaggggcgcttagcgcggtgcggtgaaaccagaatccattgcccggtgagcgggttgtagcggcgatgtggatgatcaacgggattaaattgcgtcatggtcgttccttaatcgggatatccctgtggatggcgtgactgccagtgccaggtgtcctgcgccatttcatcgagtgtgcgcgtcacgcgccagttcagttcacggtcggctttgctggcgtccgcccagtaggccggaaggtcgccctcgcgacgcggtgcaaaatgatagttaactggtttgccgcaggctttgctgaaggcattaaccacgtccagcacgctgctgcctacgccagcgccgaggttgtagatgtgtacgcctggcttgttcgccagtttctccatcgccacgacgtgaccgtccgccagatccattacgtggatgtaatcgcgcacgccagtaccgtcttcggtcggataatcgttaccaaaaatcgccagcgagtcgcgacggcctacagcaacctgggcgatgtatggcatcaggttatttggaatgccttgcggatcttcgcccatatcgcccgacggatgcgcgccaaccgggttgaagtagcgcagcagggcaatgctccagtccggctgggctttttgtagatcggtgaggatctgttccaccatcagcttgcttttgccgtaagggctttgcggtgtgccggtcgggaagctttcaacatatggaattttgggctgatcgccataaacggtggcggaggagctaaagataaagtttttgacgttagcggcgcgcatggcgctaatcaggcgcagagtaccgttgacattgttgtcgtaatattcaagcggtttttgtaccgattcgccaacggctttcagcccggcgaagtggatcacggtgtcgatagcgtgatcgtgcaggatctcggtcatcaacgcttcgttacgaatatcgccttcaacaaacgttggatgtttgccgcctaaacgctcgataacaggcagtacgctgcgcttactgttacagaggttatcaagaatgatgacatcatgaccgttttgcagtaattgcacacaggtatgacttccaatgtaaccgctaccaccggtaaccagaactctcataattcgctccattaggcttatggtatgaaataaccatagcataacaaagatgcgaaaagtgtgacatggaataaattagtggaatcgtttacacaagaatttagccgttttttatgcgcgattaagtgattataaaacagagggtttatgaatgattgcgctttttatctgaaaaaagaagcggtttcatgcctgcatgcgtcaaaccgttggccggataacacgtttacgccgcctccggcacggtcagcactaccgactcagtttatttttgtcagcgcatagcgataaaagtcaccgtccggcacgaactccagacgatgggtaatacaggcaggcgcatcttcagcgtggtgcgaaacaaacaacaattgcgtttcaccttcgctaatcagcacatcaacaaaacggcggataagctggcgattgagcggatcaagcccctgtagtggttcatcgagaataagcaacgtcggatgtttcactagcgcacggacgatcagcgccagacgctgctgtccccaggaaagactatggaaaggagcgtcagccgtgcgtttatcaatgccgagaatatccagccactgctgcaccagtttttgctggcgatccgaaacggcctgataaatgccaatcgaatcaaaatagccagaaagaatcacattacgcacagtagtgctgacccggtaatccagatgcaaactactgctgacgtaaccgatatgctttttgatatcccagatggtttcgccgctgccgcgacgtcgtccgaaaagcgtcaaatcgttgctgtaaccttgcggatgatcgccagtaatcaggcttaataacgtcgattttcccgcgccatttggcccgacaatttgccagtgttcgcctggattcacctgccagctaaggttattaagaatggggcgatcattataagaaaccacgccattgttcagcacaatgcgcggttcgtgggcgggtaaggcgtgacgtgctgaaggttcatccggctccggcatttgcacaccttcaagcagttcgctatgcgccagttgcgcaacgagtgcttgttggagcagttcttctttagcgccagtttccgctaacgtgcaatccgccagcacgccagcaaactggacaaattccgggatctcatcgaagcgattgagcaccagtaccagagtaataccggactgatgtaacgaggcgagtagctcagccagttgctgacgtgaggcaacatccaggccatcgaacggttcatcaaggatcaacaagtcaggctccgacatcagcgcctgacacagcagggtttttcgcgtctcgccagtggaaaggtatttaaagcgtcggtcgaggagggcggtaataccgaactgctgcgccagttgcatgcaacgcggtgcatcctttacttcatcctgaatgatctcagccgtagtgcgtccggtgtcatcttcgccggggccgagcatatcggtgttattccgctgccattcgtcgctgacgagtttttgcaattgctcgaaggagagacgagtgatgtgggaaaactggctttgccgttcacctttcaaaagcggaagttcccccgccagcgcgcgggccagggccgatttcccgcttccattcgaaccgacaaacgcccaactatcacccgcgtttaacgttagctgaggcaattgcagcgtttttgtgtcgctaagacgaaacgtgccttgcaaaatttgcaacgatgacattttatatcccattttgtgcagcgattactgacagggatacgtgtttcataacaaattgtcaacacgcttagcacagcgtggcgataatcacgctgtcggcattaaagtaggccgtgacattctgtccttgctgaagagaagtcgcttcatttaccggcactgtggcgcacagtgtttgcccgtccggtagcgccattaatacttcgcactgctctgcgccgcgctcaatatgactaataatacccggtaattggttgtcagcgttttgcgcgaccgcttcgtcctgagtaatgcctacccacggcgcttttagcaatatcaacacttctttgccttcatccagccccagacgcgcgccgctttgtgcggtaattgcgactttcagacgtgtttttccgtcagccagtaagacatcaacatgctgttgaacgtcatcatgatcgcgggcggtgatggtaccgaaccactggttacgggcgctggtttgcagtgaaaaacgtgagatcgcggccagcaggctgttcagcggcagggcgtcatcgtcacttaacacatcaaaggctttttgctggatttgcgccagtaagtcatagagctgaatcagtcgctgaccatagcgggtcagtactgcaccgcctccacctttaccgcctgttgcgcgctcaaccagaatatgctcacttaactgattcatctcgttaatggcatcccaggcgcttttatagctgataccggcatctttcgctccctggctaatggaaccggaaagcgcaatgtgttttagtagcgaaatgcggcgcgggtcggcgaataatttttgttggagcttaagggtgagaaggatttcggcctgcataacaatgtcctggcaaaagtcttattgtgacggaaaacgaacgccacgcaaagctgaccgcacaaaaggggagtgcttttctgtgcttagcggttagaatagtctcatgactatatctggagttgaccatgttagagttattaaaaagtctggtattcgccgtaatcatggtacctgtcgtgatggccatcatcctgggtctgatttacggtcttggtgaagtattcaacatcttttctggtgttggtaaaaaagaccagcccggacaaaatcattgattccctgaatgcccgcttagtcgggcattttcttattctcaacttcctgctttttctgccgatattttttctcatctacctcacaaaggttagcaataactgctgggaaaattccgaacttgccgttatattgacacctacataacgttacattaaggggttaccaatggctcgtaaatggttgaacttgtttaccggggcggcactctctttcgctgttgctggcaatgcactggcagatgaagggaaaatcacggtgttcgccgccgcatcactgactaacgcaatgcaggacattgctacgcagtataaaaaagagaaaggcgtggatgtggtttcttctttcgcttcgtcatctactttggcccgtcagattgaagcgggtgcgcctgcggatctatttatttctgccgatcagaaatggatggattatgcggttgataaaaaagcgatcgatacggcttcgcgccagacactgctcggcaatagcctggtcgttgtagcaccgaaagccagcgagcagaaagatttcaccatcgacagcaaaaccaactggacttcgctgctgaatggcggtcgcctcgcggttggtgatccggaacatgtccctgctggcatttatgcgaaagaagcactgcaaaaactgggcgcatgggatacgctctccccgaaactggctccggcggaagatgttcgtggcgcgctggcgttggtcgaacgcaatgaagcgccgctgggtattgtttacggttctgacgcagttgccagcaaaggggtaaaagtggttgccaccttcccggaagattcacataaaaaagtggaatatccggttgctgttgtggaagggcataacaatgcgacagtgaaagcattttacgattatctgaaggggccgcaggctgcggaaatctttaaacgttacggatttacaaccaagtaatgatactgaccgatccagaatggcaggcagttttattaagcctgaaagtttcttccctggctgtgctgtttagcctgccgtttgggatcttttttgcctggttactggtacgttgcacgtttccgggcaaagctctgctcgacagcgtactgcatctaccgctggtgttaccgcccgtggtcgtcggttacctattattagtttcgatgggacggcgcggatttatcggtgaacgtctgtatgactggtttggtctttctttcgcgtttagctggcgtggtgcggttctcgctgccgctgtcatgtcttttccgctgatggtgcgggcgattcgtctggcgctggaaggtgttgatatcaaactggagcaggccgcaagaacactgggggccgggcgctggcgcgttttctttactatcacgttaccgctgaccttaccgggaattattgttggtacggtgctggcattcgctcgttcgctcggtgaatttggcgcaaccatcacctttgtttctaacattcctggtgaaacgcgaaccattccttctgccatgtataccctgatccagacccctggcggggaaagtggcgcggcgagactgtgtattatttctattgcgctggcgatgatctccctgttgatttcagaatggctggccagaatcagccgtgagcgggcggggcgctaatcatgctggaactgaatttttcccagacgttgggcaatcattgcctgacgattaatgaaacgctgcccgccaatggcatcaccgctatttttggtgtctctggtgccggaaaaacctcgctgattaacgccatcagtgggctgacacgtccgcaaaaagggcggattgtcctcaatggtcgggtactaaatgacgccgataaaggtatctgcctgacgccagaaaagcgtcgcgtaggctatgtgtttcaggatgcgcggctgtttccgcattataaagtgcgtggcaatttgcgctacggcatggcgaaaagcatggtcaatcagttcgataagctggtggcgcttttaggcattgaaccgttgcttgatcgtttaccaggcagcctgtccggaggcgaaaaacagcgcgtggcgattggtcgggctttgctgacagcaccagaattgctgttgctggatgaaccgctggcgtcactggatattccgcgtaaacgcgaactgttgccttatctgcaacgtctgacgcgggaaatcaacattccgatgttgtatgtcagccattcgctggatgagatcctccatctggcagacagagtgatggtactggaaaacggtcaggtgaaagcctttggcgcgctggaagaagtctggggtagtagcgtgatgaatccgtggctaccgaaagagcaacaaagtagcattctgaaagtgacagtacttgagcatcatccgcattacgcgatgaccgcgctggcgctgggcgatcagcatttgtgggtcaataagctggaagaaccgctgcaagctgcgctacgcatccgcattcaggcttccgatgtctcgctggttttacaaccgccgcagcaaaccagcattcgtaacgtattgcgggcaaaagttgttaatagttatgacgacaacggccaggtggaagtggagctggaagtcggcggtaaaacgctgtgggcgcgtatcagcccgtgggccagggatgaactggcgatcaaacctggcctgtggctgtatgcgcaaattaaaagtgtgtcgataaccgcctgattaaatcaggtagctataaatgaactgggcaatgctgtcggtggtgttatcaccaatcacaatgttggcgcgcgcttttactgcgtcatcggcgttgcccatcgctacgcctgtaccagcggcttccagcatactaatatcattgaagttatcgccgaacgccacgacgttttccatcgaccagccttgtgcctcaacccatttcgtcaaacgtttacctttgctgttgccgccgcgtgcaatatcaacctgatcgtgccaggaccattcacactccagtcccagttcatgttcgacatgcttaccaaaatgctgcaattgcggcaggtcatcgtgcgtcagggcgaacttccatacggcgttaacttgttgcgccgtttcagccagagaagcgacttgtgtgaaagtcggacgctgttccggcggcagggtttgcgcccagttagacgtgcgaatgacatgcccggtcgggtgctcatagaccattgcatcatcgacatacatcagaccgtgaatgtggtgttcattcagcatctcaatgagttgcagggctttattaacgggcattgggtccgcttccagcacggtttttgcatgataatcatacaaataggtgccattacagcaaatagcaggtgtatccagcgccagcgcctgataaaaaggatgaatagcgacgtgatggcgacctgtgacgatgattaattgatagcctgcttcgcgagcgcgggccagggcttctatcgatgatggaagcaaggtctttttcggggtcaataaggtgccgtctaagtcgagagcaatcacgcgtgtggtcatggcgtattccagattaaggttaagaattttcgtctgcgcgaatggtacaccgataccactatcggacaaaattctgcgttttaattcagcattcaccgccaaaagcgactaattttagctgttacagtcagttgctaaatgcaaaggagcattcatgaagcaaacagtttatatcgccagccctgagagccagcaaattcacgtctggaacctgaatcatgaaggcgcactgacgctgacacaggttgtcgatgtgccggggcaggtgcagcctatggtggtcagcccggacaaacgctatctctatgttggtgttcgccctgagtttcgcgtcctggcgtatcgtatcgccccggacgatggcgcgctgacctttgctgcagagtctgcgctgccgggtagcccgacgcatatttccaccgatcacctggggcagtttgtcttcgtcggttcttataatgcgggtaacgtgagcgtaacgcgtctggaagatggcctgccagtgggcgtcgtcgatgtggtcgaggggctggacggttgccattccgccaatatctcaccggacaaccgtacgttgtgggttccggcattaaagcaggatcgcatttgcctgtttacggtcagcgatgatggtcatctggtggcgcaggaccctgcggaagtgactaccgttgaaggggccggcccgcgtcatatggtattccatccaaatgaacaatatgcgtattgcgtcaatgagttaaacagctcagtggatgtatgggaactgaaagatccgcacggcaatatcgaatgtgtccagacgctggatatgatgccggaaaacttctccgacacccgttgggcggctgatattcatatcaccccggatggtcgtcatttatacgcctgcgaccgtaccgccagtctgattaccgttttcagcgtttcggaagatggcagcgtgttgagtaaagaaggcttccagccaacggaaactcagccgcgcggcttcaatgttgatcacagcggcaagtatctgattgccgccgggcaaaaatctcaccacatctcggtatacgaaattgttggcgagcaggggctactgcatgaaaaaggccgctatgcggttgggcaggggccaatgtgggtagtggtcaacgcgcactaaccgctgatttaaccggcgcagtctctcctgcgccggtgtattaacctatctcctgtaacgcatgtctctggcgttcgacgatattggtccacaaattgtctttatcgtcagtccacaaattaatcagcaaggcaaaaaagcgttcagctgccggagaaagcacggcatctttgcggcgaataatccccaatgtccgacgtataacgggttccaccagtgggataccaataatcgaagaatagggcgcatggggcattgccagaccaggaagcgccgaaatccccagtcccgcctccaccagccctaatgacgtcgaaagatgacgcacttcgtaaaaccagtccagcttccagggcttgtcggctagctgttgttctatcaacagtcggttgccgctggaggagcgtacgccaatcattttgtaacccactaactcctgccattctacaagctgctttttggccaatggatggtcacgccgacaggccagcacgaacggctcgttgaccagtggggtaaaatcaatggatgaatttgtgacgttgttcatgtttatgccaaagtctgattcgttacacagcaccgattccatgcaattattcgtgccttgttccagaatccgcactttaatattgggatacagctcattaaatttaccgattgccagcggtaaaaaataaaatactgcggtcggaatacacgctaacgtcaccataccacgatgataagcattcatatcacgaatattaaaaagcgtttcatcgaatttttttattaattcccgcgcctccgggagcaaccttttcctgcttttgttaacgtaaccttgcgagttgtacgctcaaatagttgaatgtgtaaatcttcctccatcttttttattcttcgcgttaatgcaggttgcgtaatattgagtaatttagcagcattgttaaatgaactggactctgccagtatgacaaatgccttcatacttgataattcatgcttcattattactccggaaaatggaagcgacgattttgggtgactggcagttaaaaattttaactgcatttagccaacttaaattaatgaaaaaatgttattaatcgttgagctaaagtcattagagatgctttgcccttaatgtaaccatatcgcaataagttatgtttttaaattgagggcattattatgaaaaaaataccctgcgtgatgatgcgaggtggaacctcgaggggcgcgttcctgttagcggaacatctacccgaagatcaaacgcagcgcgataaaatattgatggcaattatgggttccggtaacgatctggaaattgacggtattggcggcggtaatccgctgaccagtaaagtcgccattattagccgctccagcgatccgcgtgcagatgtcgattatctgtttgctcaagttatcgtccatgagcaacgtgtcgataccacgcctaactgcggcaatatgctgtctggcgttggggcattcgccattgaaaatggtttgattgcagcgacttcgccagttacccgcgtacgtatccgcaacgtcaatacgggtacgtttatcgaagctgatgtgcaaacgccaaatggtgttgtcgagtacgagggtagcgccagaattgacggcgtaccgggtactgccgcaccggttgcgctcactttcctgaatgccgccggaacgaaaaccggaaaagtcttcccgacggataatcagattgattattttgacgatgtcccggtgacctgtatcgatatggcgatgccagttgtcattattcctgctgaatatctgggaaaaacaggctatgaattaccggcagagctggatgccgacaaagcattattagcccgcattgaatctatccgtctacaagcgggtaaagcaatgggcttaggcgatgtcagtaatatggttatccctaaacctgtacttatttctccagcgcagaaaggcggggcaattaatgtgcgttattttatgccgcattcttgccatcgcgctttggcgataaccggtgctattgctatttccagtagttgtgcattggaaggtaccgtcacccgacaaatcgtcccttctgtaggatacggcaatatcaatattgaacaccccagtggtgcgctcgacgttcatttaagtaatgaaggtcaggatgccacgacgttacgcgcatctgttattcggacgacaagaaaaatattttccggtgaagtttatcttccctgaaaaattttgttgtcgtgataatgacaatcaataaaggaattctgtatgagtcatacagaaagaacaggatattaaatgaataagaaatcgttatggaagctaattctgatattagcaatcccatgtattattggctttatgccagctccagcaggattaagcgaactggcgtgggtgctttttggtatttacctggcggccattgtggggctggttatcaagcctttcccggaacctgtcgtactgttaattgccgtcgccgcatcgatggtcgtggtgggtaacttatcaggtggggaatttaaaaccaccgccgtattaagcggttactcttccggtaccacctggctggtgttttctgcgtttactttaagcgccgcgtttgtaaccacaggcttaggtaaacgtattgcctatctgctgattggtaaaattggtagcactaccctgggtctgggttacgttacggtatttctcgatctggtactggctccggcaacaccgtctaacaccgcgcgtgcgggcggcatcgtgttaccgatcatcaacagcgtggcagtggctttgggatcagaaccggaaaaaagtccgcgtcgtgttggacattacctgatgatgtccatttacatggtcactaaaaccaccagctatatgttctttaccgcaatggcggggaacattctggcgctgaaaatgatcaacgacattctgcacctgcaaattagctggggtggatgggcgctagccgccggattgccgggcatcattatgctgctggtcaccccgctggtgatttacaccatgtatccaccagaaattaagaaggtggataacaaaaccatcgctaaagcgggccttgccgaactgggaccgatgaaaatccgcgaaaaaatgctgctcggtgtctttgtgctggcgctgctgggctggattttcagtaagtctctgggggttgatgaatccaccgtggcaatcgttgttatggcaactatgctgctgctgggtatcgttacctgggaagacgtggttaaaaataaaggcggctggaataccttaatctggtacggcggtattatcggcttaagctccttattatcgaaagttaaattcttcgaatggttagctgaagtctttaaaaataacctggcatttgatggtcacggtaacgttgctttcttcgttattattttcctcagcatcatcgtgcgttatttcttcgcttctggtagtgcctatatcgttgccatgttaccggtatttgccatgctggcgaatgtctccggcgcaccgttaatgttaaccgcgctggcactgttgttctctaactcctatggcggcatggttactcactatggcggtgcggcaggtccggtcatctttggcgtgggttacaacgatattaaatcctggtggttggtcggtgcggtactgacgatattaaccttcctggtgcatatcacccttggcgtgtggtggtggaatatgctgatcggctggaacatgctgtaaatatactcgtcatacttcaagttgcatgtgctgcgtctgtgttcgctcaccccagtcacttacttatgtaagctcctggggattcactcgcttgtcgccttcctgcaactcgaattatttagagtatatccatttattatctttctgcgcacttcacggtgcgcagatatctggagcatttgatgatcaagttatctgaaaaaggcgtgtttctcgccagcaataacgaaataattgccgaagaacatttcaccgacgaaataaaaaaagaagaagcaaaaaaaggcactattgcctggtctattctctcttctcataatacgtccggaaatatggataaacttaaaattaagtttgattcattagcctctcacgatattacctttgttggtattgtacagaccgctaaagcgtccggtatggaacgtttcccgctgccgtatgtgctgaccaactgccataactcactctgcgccgtcggcggcaccattaacggtgatgaccatgtttttggtttatcggcggcgcagcgttatggcggtatttttgtgccaccgcatattgcggtcatccatcaatatatgcgtgaaatgatggcaggcggcagcaaaatgatcctcgggtcagacagccatacccgttacggtgcgttagggacaatggcggttggcgagggcggcggcgagttggtaaaacagctgcttaatgacacctgggatatcgactatccgggcgtggttgcggtgcatctgaccggaaaacctgcgccgtatgtggggccgcaggatgtggcgctggctatcatcggtgctgtgttcaaaaacggttacgtcaaaaacaaagtgatggagttcgtaggtcccggtgttgcagcgctctctaccgatttccgtaacagcgttgacgtgatgaccactgaaacgacctgtttaagttctgtctggcaaaccgatgaagaagtccataactggctggcgctgcacggtcgcggccaggattactgccaacttaaccctcaaccaatggcgtactacgatggctgcatcagcgttgatttaagcgccatcaaaccaatgattgcgctgccattccacccgagcaacgtgtatgaaatcgacacgctgaaccagaacctgaccgacattctgcgtgagattgaaattgagtccgaacgcgtggcgcacggtaaagccaaactctcgctgctggataaagtggaaaatggtcgcctgaaagtgcagcaggggattatcgcgggctgttctggcggtaactatgaaaacgtcatcgcggcggcgagtgcgctgcgcggtcaatcctgcggcaacgataccttctcgttggcggtttacccgtcatcacagccggtgtttatggatctcgccaaaaaaggtgtggtcgcagatttgattggcgcaggcgcaatcatcagaaccgcgttctgcggcccatgctttggtgcgggcgatacgccaatcaacaacggtttgagtattcgccacaccacgcgtaacttcccgaaccgcgaaggctctaagccagctaatgggcagatgtcagcggtggcgttgatggacgctcgttctattgcggcgactgcggcaaacggtggctatttaacttcggccagcgagctggattgctgggacaacgtgccggagtacgccttcgatgtaacgccgtataaaaatcgcgtctatcaaggctttgtgaaaggggcgacccagcaaccgctgatctacggaccgaacatcaaagactggccggaattgggcgcgctgactgacaatatcgtcctcaaagtgtgctcgaagatcctcgacgaagtaaccaccaccgacgaactgattccttccggtgaaacctcttcttatcgttcaaatccgattggtctggcggagtttaccctgtcacgccgcgatccaggttatgttggcagaagtaaagcgactgctgagctggaaaatcagcgtctggcgggaaatgtcagtgagctggcagatgtgtttgcgcgcattaagcagattgctggtcaggaacatgttgatccgctgcaaactgaaattggcagcatggtttatgcggtgaaaccaggcgatggttctgcgcgtgaacaggcggcgagttgtcagcgtgtgattggcggtctggcgaatattgccgaggagtacgcgactaaacgctatcgttctaacgtcatcaactgggggatgttaccgctgcagatggcggaagtaccgaactttgacgtaggtgattacatttatatccctggcattaaagcggcgctggataatcctggaacgacgtttaaaggttatgtgatccatgaagatgcaccggtgacggagattacgctctatatggaaagtatgactgctgaagagcgcgagattatcaaggcgggtagtttgattaacttcaataaaaaccgtcagatgtaaaaagcgccatgtgaatgtaggtcgcatccggcacttattgtcggatgcgatgctggcgcatcttatccgaccgacaaatcgcatcgaaccgtaggccggataaggcgtttacgccgcatccggcacatagttaacagctcctacttcttcgcctctgcaaccactttgctacccacgccgcggttattgtattcccacatgcggttgtagttagtgtcattcagattgcgctgtacttcgtcgttatcatcaacgctgccggtgttacccgcgaatggacgattggaaatcaccgcatcagcccacggtttggctgtgttaaaaccttcgttgatggcgctatcacggatcactacctgaccgttggtattggcatcaacatccagcgagcggcccagttgcgccacgccatcaccggaagcattgaaacggctgtttacggcgaggaaaccgtagtaaatgttggacagcgtagccggtgcaaacacatacgcttcttgctgggtacgggagttcaccacgcggaattcggtgttatcgaacaccactgcgccgcgaccagaaacgatatccacatccccttcaatatagctgttggtcaccagcgtacgcggctgacgattcgtttccagacggttctgcacaccgctgttggtgacaaagaaggtgttctgacgaccgagaatgttgacgttattgatctgcactttgtcgccatcagtacgcagtgccaccgccggatggttacccgcatctacgctatcgcccagcgtgttttcgatggtcaggttttgcagttgcaggccattgttttgtgaccagaagaccgcagagcagagaacaccgatactgtcgctgcgtttactctggcagctatcgtacatataccacgccggtttacctggcatatatttgccgcgcgggttgacgtcgtgacgccagtcggcagggctcatgccaccatcaagggaaagcccaatcttcacatcaatcggtttttcacctgtaccgtatagagtaattccacccggagcggcagggacatacaccgttccctgatactcaccaggcatcacggcaatatactggcgcttgttggtacgcttgataattgccgcatctaccgccgcctgaatcatggtatgcgttacaccttgagtacccgccgggccgacaacaaagtcaggttgcgcaggcagggtaatcggggaaggattccacgctgccgcacctggtgtcagggatgcaaaatagtgttgagcatcgaaattctgcgcttcttttgccgacagaatcgggcgcgaagaggtaccaggcgcggtttgatcagaaggacgttgatcgggcggtgttgagctacaggcggtcagcgtcacgccaaaagccaatgccagcgccagacgggaaactgaaaatgtgttcacaggttgctccgggctatgaaatagaaaaatgaatccgttgaagcctgcttttttatactaacttgagcgaaacgggaaggtaaaaagacaaaaagttgtttttaatacctttaagtgataccagatggcattgcgccatctggcagagtgattaactaaacatcgcagtaatcgaggcactcgccagagagtgaaaatgaacgttaaacccgaccatcgcgccgctggcaccttcatcgacatcaatacgttctacatccagcgcgtgaacggtaaaaatgtagcgatgggtttcgcctttcggcggcgctgcgccatcgtatccggttttaccaaagtcggtacgcgtctgcaaaacgccgtctggcattgctaccagaccagagccaaacccttgcggtaatacgcgggtatcagcgggtaaattaacaactacccagtgccaccagccggagccggttggcgcatccgggtcgtagcaggtgacaacaaaacttttcgttcccacaggaacatcatcccacgccagatgcggtgaaatattatcgccatcgtaacccatgccgttaaagacatgacgatgcggcagcttatcgccatcgcgcagatcgttactgatgagtttcatgaaccctcctttcttgtttgcagaaagtgtagtcagaaaccctcacgctgacttcccgttattggcaaaaaaatgtttcatcctgcaccgcacggttaaccgctgcggtcagacgctgcaactgttgcgggagaataatatagggcggcatcaggtaaatcagtttgccaaaaggccggatccagacaccctgttcgacaaagaatttttgcagcgctgccatatccaccggacgagtggtttcgaccacgccgattgcccccagtacgcgcacatcggcaaccatttcggcgtcacaggcgggggcaagttgctcgcgtagctgcgcttcaatagccgccacctgatgctgccagtcgccagattcaagaatcgccaggctggcgtttgctgctgcgcaggccagcggattgcccataaaagttggcccatgcataaagcagccggcttcgccgttactgatggtttccgcaacctcgcgcgtggtgagcgtggcggaaagggtcattgtgccgccggttaaggctttaccgagacacaaaatatccggcgcgatttctgcatgttcacaggcaaacagtttgccggtacgaccaaatccggtggcgatctcgtcggcaatcagcaagataccttcgcgatcgcacattttgcggattcgttttaaccattccggatggtacatgcgcatcccgcctgcgccctggacaatcggttcaatgatcaccgccgcgatttcatgacgatgcgctgccatcaggcgggcaaagcccaccatatcacgctcatcccattcgccatccatgcggctttgcggggcgggagcaaacaggttttctggcagatagcctttccacaggctgtgcattgagttgtccggatcgcacaccgacatcgcgccaaaggtatcgccatgataaccattgcggaaggttagaaaacgctggcgcgcttcgcctttggcctgccagtactgcaacgccattttcatcgccacttctaccgctacggagccggagtccgcgagaaaaacgcactccagcggttgcggcgtcattgctaccaatttgcggcacagctcaatggcgggcgcatgggtgataccgccaaacatcacatgcgacatagcatcaatttgcgacttcatcgccgcattaagctgcgggtgattgtaaccgtggatcgccgcccaccaggacgacataccgtcaaccaggcgtctgccgtcagacaaaattagctcgcaaccttcggcgcttgccaccggataaaccggcagcggggaggtcatggatgtgtatgggtgccagatatggcgttggtcaaaggtaagatcgtccgttgtcataatcgacttgtaaaccaaattgaaaagatttaggtttacgagtctacaccgaattaacaacaaaaaacacgttttggagaagccccatggctcaccgcccacgctggacattgtcgcaagtcacagaattatttgaaaaaccgttgctggatctgctgtttgaagcgcagcaggtgcatcgtcagcatttcgatcctcgtcaggtgcaggtcagcactttgctgtcgattaagaccggagcttgtccggaagattgcaaatattgcccgcaaagctcgcgctacaaaaccgggctggaagccgagcggttgatggaagttgaacaggtgctggagtcggcgcgcaaagcgaaagcggcgggatcgacgcgtttctgtatgggcgcggcgtggaagaatccccacgaacgcgatatgccgtacctggaacaaatggtgcagggggtaaaagcgatgggtctggaggcgtgtatgacgctgggcacgttgagtgaatctcaagcgcagcgcctggcgaatgccgggctggattactataaccacaacctcgacacctcgccggagttttacggcaatatcatcaccacccgcacctatcaggaacgtctcgatacgctggaaaaagtgcgagaagctgggattaaagtctgttcaggtggcattgtgggcttaggcgaaacggtgaaagatcgcgccggattattgctgcaactggcaaacttgccgacgccgccggaaagcgtgccaatcaacatgctggtgaaggtgaaaggcacgccgctggcggataacgacgatgtcgatgcctttgattttatccgtaccattgccgtagcgcggatcatgatgccgacctcttacgtacgcctttctgccggacgcgagcagatgaacgaacagactcaggcgatgtgctttatggctggcgcaaactcgattttctacggttgcaaactgctgactacgccgaatccggaagaagataaagacctgcaactgttccgcaaactggggctaaatccgcagcaaactgccgtgctggcgggcgataacgaacaacagcagcgtctggagcaggcgctgatgaccccggacactgacgaatattacaacgcggcagcactatgatctggcaggagaaaatcgacgcggcgctcgatgcgcggcgtgttgctgatgccttgcgtcgccgttatccggtggcacaaggagccggacgctggctggtggcagatgattgccagtatctgaacttttccagtaacgattatttaggtttaagccatcatccgcaaattatccgcgcctggcagcagggggcggaacaatttggtgtcggtagcggcggttccggtcacgtcagcggttatagcgtggcgcaccaggtgctggaagaagaactggccgaatggctgggctattcgcgggcactgctgtttatttctggttttgccgctaatcaggctgtcattgccgcgatgatggcgaaagaggaccgtattgttgccgaccggcttagccatgcctcattgctggaggctgcaagtttaagcccgtcgccgcttcgccgttttgctcataacgatgtcactcatctggcgcgactgcttgcttccccctgtccggggcagcaactggtagtgacagaaggtgtgttcagcatggacggcgatagtgcgccactggaggaaatccagcaagtaacgcaacagcacgatggctggttgatggtcgatgacgcccacggcacgggcgttatcggggaacaggggcgtggcagctgctggctgcaaaaggtaaaaccagaattgctggtggtgacgtttggcaaaggatttggcgtcagcggggcagcggtgctttgctccaatacggtggcggattatctgctgcaattcgctcgccatcttatctacagcaccagtatgccgcccgctcaggcgcaggcattacgtgcgtcgctggcggtcattcgcagtgatgagggggatgcacggcgcgaaaaactggcggcactcattactcgttttcgtgccggagtgcaggatttgccgtttacgcttgctgattcatggagcgccatccagccattgatcgtcggtgataacagccgtgcgttacaactggcagaaaaactgcgccagcaaggctgctgggtcacggcgattcgcccgccaaccgtacccgctggtactgcgcgactgcgcttaacgctaaccgcagcgcatgaaatgcaggatatcgaccgtctgctggaggtgctgcatggcaacggttaataaacaagccattgctgcggcatttggacgggcagccgcacactatgagcaacatgccgatctacagcgccagagtgctgacgccttactggcaatgctcccacagcgtaaatacacccacgtactggatgcgggttgtggaccaggctggatgagccgccgctggcgagagcgtcacgcgcaggtgactgcgttagatctctcgccgccaatgcttgttcaggcacgccagaaggatgccgcagaccattatctggcgggagatatcgaatccctgccgttagcgactgcgacgttcgatcttgcatggagcaatctcgtggtgcagtggtgcggtaatttatccatggcactccgcgagctgtatcgggtggtgcgccccggaggcgtggtcgcgtttaccacgctggtgcagggatcgttacccgaactgcatcaggcgtggcaggcggtggacgagcgcccgcatgctaatcgctttttaccgccagataaaatcgaacagtcgctaaacgccgttcattatcaacattatattcagcccatcacgctgtggtttgatgatgcgctcagtgccatgcgttcgctgaaaggcatcggtgccacgcatcttcatgaagggcgtgacccgcgaatattaacgcgttcgcagttgcagcgattgcaactggcctggccgcaacaacaggggcgatatcctctgacgtatcatctttttttgggagtgattgctcgtgagtaaatgttattttgtcaccggaacggataccgaagtggggaaaactgtcgccagctgcgcgcttttacaagccgcaaaggcagcaggctaccggacggcaggttacaaaccggtggcctctggcagcgaaaagaccccgaaaggcttacgtaatagtgacgcgctggcgttacagcgcaacagtagcctgcagctggattacgcaacggtaaatccttacaccttcgcagaacccacctcgccgcatatcatcagcgcgcaagagggcaggccgatagaagcattggtaatgagcgccggattacgcgcgcttgaacaacaggctgactgggtgttagtggaaggtgctggcggctggtttacgccgctttctgacactttcacttttgcggattgggtaacacaggaacaactgccagtgatactggttgtgggcgtgaaactcggctgtattaatcacgcgatgttgactgcgcaggcaatactacacgacggactgactctggcggggtgggtggcgaacgatgtcacgcctccgggaaaacgtcacgctgaatatatgaccacgctcacccgcatgattcccgcgccgctgctgggcgaaattccctggcttgcagaaaatccagaaaatgcggcaaccggaaagtacatcaatcttgccttaatgtagtcatcctgtgcttggttaaattgtgagcgagatcgcgtctccgattgactgcaatttaaccaattaaattctaaaaaaatcacgaaaaaaattttacctccgcatcatgcggtgaatgtgggaattgcccaggcgacgggggataggggctgcagacagttatccactattcctgtggataaccatgtgtattagagttagaaaacacgaggcaagcgagagaatacgcggcttgcacgcgaattggcgttaaagacggctcaaagaaatatcttttattttttaacaggttagataattgcaatggcagtcactgaacaggcatctcttgccataaaactgtcatcaatcatcttgacaaatgttaaaaaagccgttgctttggggataacccggtaaggccggagttttatctcgccacagagtaaatcttgttcatgattgacagcggagtttacgctgtaacagaaatattatggtgatgaactgtttttttatccagtataatttgttggcataattaaatacgacgagtaaaattacatacctgcccgcccaactctttcaggtagcgactcatgagtaaaccgttcaaactgaattccgcttttaaaccttctggcgatcagccggaggcgattcgacgtctcgaagaggggctggaagatggcctggcgcaccagacgttacttggcgtgactggctccgggaaaaccttcaccattgccaatgtcattgctgaccttcagcgccctaccatggtacttgcgcccaacaaaacgctggcggcccagctgtatggcgaaatgaaagagttcttcccggaaaacgcggtggagtatttcgtctcctactacgactattatcagccggaagcctatgtaccgagttccgacaccttcattgagaaagatgcctcggtaaacgaacatatcgagcagatgcgtttgtccgccaccaaagcgatgctggagcggcgtgatgtggttgtggtggcatcggtttccgcgatttatggtctgggcgatcctgatttatatctcaagatgatgctccatcttacggtcggtatgattatcgatcagcgcgcgatcctgcgtcgactggcggagctgcaatacgctcgtaatgatcaagccttccagcgcggtactttccgcgttcgtggggaggtgattgacatcttcccggcagaatcggatgacattgcacttcgcgtggaactgtttgacgaggaagtggaacgattgtcgttatttgatccgctcaccgggcagattgtttccactattccacgttttaccatctacccgaaaacgcactacgtcacaccgcgcgagcgcattgtgcaggcgatggaagaaattaaagaagaactggccgccagacgcaaagtgctgttggaaaacaacaaactgctggaagagcagcggctgacccagcgtacccagtttgatctggagatgatgaacgagctgggctactgttcggggattgaaaactactcgcgcttcctctccggtcgtggaccgggtgagccaccgccgacgctgtttgattacctgcctgctgatgggctgctggtggtcgatgaatctcacgtcaccattccacaaattggcggtatgtatcgcggtgaccgggcgcgtaaagagacactggtggagtacggcttccgcctgccatcagcgctggataaccgtccgctgaaatttgaagagttcgaagcattagcgccgcaaaccatctatgtttcggcgacgccgggtaattacgagctggaaaaatccggtggcgatgtggtggatcaggtggtgcgtccaacaggcttactcgacccgattatcgaagtgcggccagtggcaacacaggtggatgatcttctttcggagattcgtcagcgagcggcaattaacgaacgcgtactggttacaactctgaccaagcggatggcggaagatctcactgaatatctcgaagaacacggtgagcgcgtgcgttatcttcactcagatatcgacaccgtcgaacgtatggagattatccgcgacttgcgtctgggtgagttcgacgtattggtagggatcaacttactgcgcgaaggtctggatatgccggaagtttcgctggtggcgatcctcgacgctgacaaagaaggcttcctgcgttccgaacgttcgttgatccagaccattggtcgtgcggcacgtaacgttaacggtaaagcgattctctacggcgataagatcaccccatcaatggcgaaagcgattggcgaaaccgaacgtcgccgcgagaaacagcagaagtacaacgaagaacacggcattacgccgcaaggcttgaacaagaaagtggtcgatatcctggcgctggggcagaacattgccaaaaccaaagcgaagggcagaggaaaatcgcgcccgattgttgagccggataatgtgccgatggatatgtcgcctaaagcgttacagcagaagatccatgaactggaagggttgatgatgcaacacgcgcagaatctggagttcgaagaagcggcgcaaattcgtgaccagttgcatctgttgcgtgagctgtttattgccgcgtcgtgacaagatgacgaagccggaatattcttccggcttcgtgttaacctaaagcctgtaatgccttttccagcgcgctatgcaacaactggcggtcatgacgatacggaatatcgctggcctccagcacttcctgaatcacaatccgctctttcaccgccgagacatccacttttggcccgacgatgaccgcatcaattacctttttaccgacatactgctccataattgccagcttgctttccagcttcagattagccgcaggtaaacttaactcacgccccagattgccgatatagaccatcggcgctggcgtgcggcgtaatgcctgtgcgatttccttcagcagcagaattggcatcaggctggtgtaaaaactgccaggcccaataatgatgagatccgcttcactgatagcgtgaaccgcctcacgcgttgcgggtacattcggcgttaacaataactcttgaatcggcgtagttaactggtcgatattgacctcgccgtatacttcatgcccctgatcgtcaatcgccatcagatccaccggatgctccgacatcggaatcaaatgtgcgtccactttcagcagatttcgaatcagattgatcgcttcaagaggtcgcacgctaaggtgatccagtgccttcagcatcaggtttccaaggttgtgcccggaaagttcgccattaccgccgaaacgatattcaaacattgcggaagcgacgctgggttcagttatcagctggttgaggcagttgcgcatatcgccccaggcaatgccgccttctgagcggcgaatacgccccgtcgagccaccgttatcggtggtggtgacgatacccgttaaacgagaacccaaagacgaaagtgatgagagaacgcgtcccagtccatgccctccgccgagagcaacgacacgatcaaggtcagccagcgtacgattgcgcatatagtttcctggagtcagattatccgcgctacagtagcgcaaattgcgaggaaacagcaattaacctgccaatattgaggatacaaactattttcttctacctctaaaggacgatgcacgctatgcctccctgatgatgtatatcaaagtaaaaccgccattttcccttattctgtagcgaaatagcacgatcatgacgctatatacatgattacatagcgaaagtgtggatggtaaaaatctcatttacacgctagtatcggcttaaccactaaacactctagcctctgcacctgggtcaactgatacggtgctttggccgtgacaatgctcgtaaagattgccaccagggcgaaggaagaaatgacttcgcctcccgtatctggaaaggtgtacatggcttcacaactgactgatgcatttgcgcgtaagttttactacttgcgcctgtcgattactgatgtgtgtaactttcgttgcacctactgcctgccggatggttacaagccgagcggcgtcaccaataaaggctttctgaccgtcgatgaaattcgccgggttacgcgcgccttcgccagtctgggcaccgaaaaagtccgtctgacaggtggtgagccatctttacgccgcgactttaccgatatcatcgccgctgtgcgagaaaacgacgctattcgccagatagcggtcaccaccaatggttaccgtctggagcgcgatgtggcgaactggcgcgatgctggacttactggcatcaacgtcagcgttgatagccttgacgctcgccagtttcatgccattaccgggcaggataaattcaaccaggtcatggcaggaatcgatgctgcatttgaggccggttttgagaaggttaaagtcaataccgtgctgatgcgtgatgttaatcatcaccagctcgacacctttctgaactggatccagcatcgtcccattcagctgcgtttcatcgaactgatggaaacgggcgagggcagcgagctcttccgtaagcatcacatctctggtcaggttctgcgtgacgagctactgcgtcgcggctggatccaccaattacgtcaacgcagcgacggtcccgcgcaagtcttttgtcatccggattacgccggagagattggccttatcatgccgtatgaaaaagacttctgcgccacttgcaaccgcctgcgcgtttcctccattggtaaactccatctctgcctgtttggtgaaggcggcgttaacctgcgcgatctgctggaagacgatacccagcaacaggcgctggaagcgcgtatttcagcggcgctgcgggagaaaaaacagacccatttcctgcatcaaaacaacaccggtattacgcaaaacttatcgtacattggtggctaaaacgtcaaaaggagagatcagatgagtcaggtaagcactgaatttatcccgacccgtattgctattcttacggtttctaatcgtcgcggtgaagaagacgatacctccggtcactatctgcgcgattcggcgcaagaagcgggccatcacgttgtcgataaagccattgtgaaagaaaaccgctacgctattcgcgctcaggtatctgcgtggatcgccagcgacgatgtacaagtggtgttgattacgggtggtactggcctgacggaaggagatcaggctcccgaagcgctgctgccgttgttcgaccgtgaagttgaaggttttggtgaagtgttccggatgttgtcgttcgaagagattggcacttccacgttgcaatctcgtgcggtagcgggcgtcgctaacaaaacgctgattttcgccatgccgggttcgaccaaagcgtgccgtaccgcatgggaaaatatcattgcgccgcagctggatgcccgtacgcgtccgtgtaatttccatccacatttgaagaaataagtatgtcgcaactgacccatatcaacgccgctggcgaagcgcacatggtggatgtctccgccaaagcggaaaccgtgcgtgaagcgcgcgccgaagcctttgtcaccatgcgcagcgagacgctggcgatgattattgatggtcgccaccacaaaggcgacgtatttgccactgcgcgtatcgccggtattcaggcggcaaaacgcacctgggatctgatcccgctgtgtcacccgctgatgctcagcaaagttgaagtcaatttacaggccgagccggagcacaatcgggtacgtatagaaaccttatgccgcctgaccgggaaaaccggtgtcgaaatggaagcgttaaccgcggcctccgtggcggcgctgaccatttatgacatgtgcaaagcggtgcaaaaagatatggtgattggtccggtacgtttgctggcgaagagcggcggcaagtcgggtgactttaaggtggaagcggatgattaacgttctttttttcgcccaggtgcgcgagttggtggaaacagatgcaaccgaagtggctgcggatttcccaaccgttgaagcgttacgccagcatctggctgcgcagagcgatcgctgggcgctggcgctggaagatggcaaattgctggctgctgtcaaccagacgctggtgagttttgaccattcgctgactgacggcgacgaagtggctttcttcccgccggtaaccggaggttaagatggcagaaaccaaaattgttgtcggcccgcagccgttcagcgtaggagaagagtacccgtggctggctgagcgtgacgaagacggtgcggtagtcacctttaccggtaaggtgcgcaaccataacctgggcgacagcgtcaaagcattaaccctcgaacactatccgggaatgacagaaaaagcactggcagaaatcgttgatgaagcgcgtaaccgctggccgctggggcgcgtcacggtaattcaccgcattggtgaattatggccgggcgatgaaattgtttttgtcggtgttaccagtgcgcatcgcagcagtgcgtttgaagccgggcagtttattatggattatctcaaaacccgcgcaccgttctggaagcgcgaagccacgccggaaggcgaccgctgggtcgaagctcgggagagcgatcagcaggcggcaaaacgctggtagtttattgttagccggataaggcaccgctgcgtccggcaatttcaccgctcagtacatccgtttacgctgcgtcgatgcacagcctcatcattttgcagtatccttaagatattccttatatcttcaggagaaagtcatggacagattcccacgttctgattcaatcgtacaaccccgggctggcttgcaaacttatatggcgcaagtctatggctggatgaccgttggcttgttgctgacagcatttgttgcatggtatgcggctaattccgcggccgtgatggagctgttgtttactaaccgtgtctttttaatcggtctgatcatcgcgcaattagcattggttattgtgttatcagcgatgattcaaaagttgagcgcaggtgtaacgacgatgctctttatgctttattcggcgctgacgggtcttacgctttccagtattttcattgtctataccgctgcttctatcgccagtactttcgtcgttactgccgggatgttcggcgcaatgagcctgtacggttacaccacgaagcgtgatctaagcggctttggcaatatgctgtttatggcgttaatcggcattgtgctggcatcgctggttaacttctggctgaaaagtgaagcattgatgtgggcagtcacctacatcggcgtgattgtctttgtcggattgacggcgtatgacacccagaaactgaaaaatatgggtgagcagattgatactcgcgacacgtcgaacctgcgcaaatattccattcttggcgcgttaaccttgtatctggacttcatcaacctgttcctgatgttgctgcggatcttcggcaaccgccgttaattctttttcaccatcaatatcccggccatgtgtcgggattttttttcttactaaaaacgacacttaacaagtaccaggtataaaatatgccttatggacgagcggaagcgttttctgtatccataaatgcaaaagtattttgtatgcgtagttttaaatttattgatggtgaatattaatgttttttctaaggacaactaaaagaatggaatcatactcgcaaaatagcaataaagtagattttcagcacgaagccaggatattaaacggcatatgtctcattaccgctttgggtttggtggcaaccgcagggctggcctggggcgctaagtatctcgaaattacggcaacaaaatatgattcaccgcaaatgtatgttgctataggattattattactttctatgtatggcttaagtaaagatatcaacaagataaataccgccatcgcgggcgtaatatatttgtttttaatctctttggtggcgattgtcgttgcgagtttagcgcctgtatctgccattatcgtcgtgttcagcactgcgggatcgatgtttttaatcagtatgctggcaggtctattgtttaaatttgatcctggttctcaccgttttatcattatgatgacgttgacagggttggccctggtaatcatcgtgaatgccacattaatgagtgaacgacccatttgggtaataagttgcttaatgattgtcttatggtcaggcattatctcgcatggacgaaataagctccttgaactgacaggaaaaagccatagtgaagaattatggagtccggttcgttgtgcttttgtaggtgcattaacactctattattattttatcggcttctttgggattcttgccgctatagctataacgcttgtctggcaaaggcatacgcggttttttcattagccgtaaatgcacatactaaagaacttaactatacttcacatcgccgcttcatttttcgcccgtagcttcttcgcctggctttccagcaacaggtaacagatcagcgccagcagcagtgggataaagtaatacagcacacggtaagcgagcagggcggcgataattgtgcctttggaggtatgctccccagccagtagcgcgataaacaccgcttccagcacaccaattcccgccggaatatgcacgatgacgccagcaatactactaaccagcaacacgcccagtacaaagaaatagttcacgctttgaccaagtaacagccagataatcgctcccattaccatccagttaacgctggaaatcagcatctgggcgagggcgaatttccacgaaggcagcaccagcttttgccctttgatggtcatatggcggtgcttcgcgaaagcgcaaaaccacaaataaaccgcgataatcaccagtaagccaataccgagaatacgcagcgtagtttgatcgacataccagtgatccggcaactccaccacgcctgcggtaaagataacccccgctagcaaaatatagcctagccagttggtggtaatactgagcgaaaaaatccgcgtaatagtgctgcccggtaaccccagtcgggagtacaaacgatagcgcataccaatgccgccgacccaggtactgagtgtcaggttgaaggcgtagcagataaacgacaccagcatcacctggcgcttcgccagtttgtgaccgcagtagaaacgggcgagcaggtcgtagcaaccgtaaatcagataactgacgaccaccagcccgaccgcactaagcagcgcaacgcgattgtagtcgcggatgaccttccagacctcttcccagtccacttttttggcgtagaccaccagcaacacaatcaccgcgataaaaaacagccaggtgaggagtttctttgctaagcgccagcgcgggtgtgatttactcatcagggttttacccccgtgttttcagtttctacccgatcctgcgtttccattgtcggttgtgcggggggatcaacctgcgccagacgtggcgtgtgcgccggaagccagcccaccagcgccgggaagtggcgtagaaagtggaacgccagcacgcttttagtcaggttccaccaggtgcgtttcggcagcatggtctcatcgacctgctgacaatctgcggcaataatgccgttcagattatcgcgcagcgtctggttaaaatgacgatcgtggatgatgacatttgcttcgagattcagtgacaaactgagcggatcgagattactggaccctactgtcgcccagtgatcgtccatcaatgccactttgccgtggagcgggcggcggcggtactcaaacacctgaacgccacctttaaccagatagttatacagcaaacgcgcgccgactctgacaatcggcatatccggttcgccctgaatgatcagtttgatccgcaccccgcgccgtgccgctttacgcaaggcgtgtaaaaaacgatagccggggaagaagtaggcgttggcgataatcacttcccgccgcgcttgagcgagcattttcagatagtgacgttcgatatcatcgcgatgttcttcgttatcgcgccagaccagcaatacctgcgcttctcccggctggcggttctcttccgctttatgatgacgtcgccaccagcgtcgcgccgcgctttgtcctggcaggttttccagctcaaactggagaatatcttcgacaatcggcccttcgaggcgtaccgcgtaatcctgtttggcctccgggccgtagctggacatatgctcggcggagtaattcagcccgccaataaaggcgatacgcgcgtcgatcaccacaattttgcgatgcatccggcgaaacacattggtgcgcataccaaaaaggcgagggcggggatcgtagtagcggaacaccacgccagctgccgtcagttcattgacaaactcatcgctgagatccggcgaaccgtagccatccagcaagacttccgcttttaccccgcgttgcgctgctgccaatagcgccgcatgcagctgtttgccgacgtcatcctcaaaccagataaacgtttcaagaatgatgcgttcttgtgcctctccaatcgccttaaacaccgcgggataatattgctcgccgttttccagcaactggatcttattgccttcgcgccagctacatttcataaatgaatctccgcacttaaaggggcatgatcagaaaggtgtcgccatgtccgcagcggcaacgcggttggcgcgctggcgctggcatttttgacgtagatcctgtccagacgtagtagaggaaattgcaccggaaacgtgcgcgccgggcgtccgtgggcgcgggtaaaaatctcatccagcccggcctgcacttttaacggatgattagctttttgccgccagtcgttgaaatcacccgctaccaataccggttcgccgtccggtagctcattcacccattcggcgagcatcgcaagctgcgcctgacggtgcgcctcacgcaggcccagatgtacgcacatcacatgaatcgctttcccggtcatcggcggcacaatgcggcagtagagcacgccgcgcttttccgcaccatcgaccgaaacatcacgattctcataatgttcaatgggataacgtgaaagaacggcgttaccgtgatgtccttccgggtatacggcattgcgaccgtaggcgaaatcgctccacatggtgtcggcgagaaactcgtagtgcgaggtatcgggccagttttccacatgcagcggatgaacttcgtgcgcgcccatcacttcctgcaggcaaacaatatcggcgctgacggtacgcacggcgtcgcgaagttccggcaaaatgaagcgtcggttaaacgcggtaaagcctttgtgaatattgatggtgagcaccttgaacgaaaattgttgtgtttgatcgggcataattttcctgtctttgcctcttatctcattgaaatagtgtagtcggcgtcacaaaaaggtgcggtcttacggaattttccgtaaagttcggtactctgaataagtagagataaattcttcaggagagaagccatgaagtggcaacaacgtgttcgtgtcgcaactggcctaagttgctggcagattatgttgcatttactggtagtggcgctgctggtggtgggctggatgagtaaaactctggttcacgtcggcgtaggattatgcgcactgtattgtgtcacggtagtgatgatgctggtgtttcagcgccaccccgagcaacgctggcgtgaggtggcagacgtgctggaagagctgaccacgacctggtattttggtgcagcgctgattgtgctgtggctgttgtcccgcgtactggaaaacaactttttgctggcaattgcagggctggcaatccttgccggcccggcggtggtgtctttgctggcgaaagataagaagttacatcaccttacgtctaaacatcgcgtacgccgctgaccctgtcgtggccgttatcaccagtagcggccacaaactattccacacaatatccagactcgcatccttcaaataaatctgcttggtaatgtccgtaaagtggcgaatagggttaatccacgtcagattttgcagccacattggcatgttttccaccggcgaaacgtaaccggaaaggagaatggcgggcatcataaagacaaacacgccgataaatgcctgctgttgcgttgaacagagcgatgaaatcaacagaccgaatcccaccagcgataaaccgtaaatcaccatcgtaaagtagaacagcgccagcgatccggcgaagggaatttgatacgcccagataccaatcgccagcacaatggtggcctggaaggtggcgacaattaatgccggtacggctttgccgatgaatatctgccaggtggtgagcggcgaaaccagtagctgatcgagcgtaccttgttcacgttcgcgggcgacagaaagtgaagtgacgatcattacgccgatagtggtgatcatggcgatcagcgacggcactacaaaccatttgtagtcgagattcgggttataccagttgcgtaccaccagctcgctgttgttgggtttcggttttccttccagcagctcctgctgataatttttgacgatctgttgcaggtagttggcggcaatttgcgcactgttggagttacgcccgtcgaggatcaactgcaacggcgcggtctggaaggtatccagtttgcgcgagaagtcagccgggaaacgcaccagtagtaacgtcttttgtgtgtcgatggtcgggcggatctcctgcgggcttttcagcagcagcacatgggtaaaggcgctggcgcgggcaaaacgttgagtaagttccaccgaatgctcgccgttatcttcatcgtagatggcgatggtggcgttggtcacttccagcgtggcggcgaacgggaacaggatcacctgaatcagcacgggtaaaatcagaattgcgcgggtttgcggttcgcgcagcagcgactgcaactctttgcggattaacgtccataagcgatgaaacatgctcttctccctaatccagccgacgtttggttttcagccacgtcaggccgataaacatcaccgccgaagcgatcaaaaacagcacgttcactatcagcaccactggaatattcccggcgaggaacaggctttgcagggtgctgacgaaataacgtgcgggaataatgtacgtcaccgcgcggatcaccgcgggcatactgtctatctgaaatataaagccggaaagcataatcgacggcagaaaagccgcgttcagggccacctgagcggcgttgaactggttgcgggtaatcgtggaaatcagcagccccatccccagggtactgagtaaaaacaggctggagataaaaaacagaatcagcagcgacccgcgatacggcacgccgagaataaacaccgacaccagcatacacagcaacatcgccagcatcccgagaaagtaataagggatcagcttacacagcagcagctccgtgcgggtaatctccgtagagagcaaagcctccatggtgccgcgttcccattctcgcgctaccaccagcgaggtgagaatcgcgccgatgaccgtcatgataatggtcaccgcaccggggataataaagtgctggcttatcgccgcggggttaaaccagtagcgggtttgtacatcaataagcggttcaaaagtctgcccgttatcctccgcgcgctgcatttgccagatctgccagatcccttcgacatacccctgcacaaagttagcggtattcggctcactgccgtcggtgatcacctgaatcggtgcggtggcgttggcgcgctccatctgttcggcgaaatccaccggaataaccaccagaccgcgaattttccccgcctgcattttggcgatcagttcctgacggttatcgctgatggtggcgtcgatgtagggcgaaccggtcatggtgtgggtgaaatccagcgccgcttcgctacgctgttccagtaaaatcccgacgcgcagcttgctggagtcgaggttaatgccgtatccaaaaataaacagcagtagcagtgggatcactaccgcaatcagccagctactcggatcgcgaacaatctgccgcgtctctttgacgcacagcgcccgcacgcgacgccaggacaggatcggattactcattgctatgctccttatcccagtcgtggatcaactgaataaaggcttgctccatcgtgggatcgggttgctcatcgttggccgactgcgctttcaaatcgtccggtgtgccgctggcgattaatttcccgcggtacaccaggccgatgcggtcgcaatattccgcttcatccataaagtgggtggtgaccatcaccgtgacgcctttctctaccatactgttgatatgtagccaaaattcacggcgggtgaggggatcaacgccggacgtcggttcgtcgagaaacagaatgtccggttcatgcatcagcgaacaggccagcgccagccgctgtttaaaacctaatggcagttcatcggtcgcgtgggaggcgatacttttcaggcagaacgcctcgctcatacgggagattttttcgttctgcgcccgaccgcgtaagccatacacaccagagaaaaagcgtaaattctgttcgaccgtcaggttgccgtagagcgaaaatttttgcgccatatagccgagatgctggcgcgctttaccagaactctctttcagatccatgcccagcaccagcgcctgaccagaggtcggtaccagcaaaccgcacatcatcttaaaggtggtcgatttacccgcgccgtttggtccgagcaaaccaaaaatctccccgcgtttaacggcaaagttgacgtgatcggtggcggcaaaatcaccaaatttcttggttagttccttcgcttcgatcaccgtctcgccgggtgtgccttctaccgtatgtaatattgcgcccagcggcgattccgaggttccggcaccgcccagcaaatcaataaacgcatcttcaaaacgcggcgtagtttcgttgatgtcgatttccggcatcccgtcggcatggcgaatatcgtctggcgtggtctcttttttgaggatcagacgtaccgatttcccctgaatcatgccgtcgctgacctgcggcagtttcaatgcccgttgcaacagtttgcggttgccctcgtgcgggctggtcatcagaaagctgcgtccggccatggtttgagtcagggccgtcggttctccctgatacagcagctcgccttcgttcatcagtaacacgtcacggcactgctcggcttcgtcgagatacgaggtactccagaggattaacatcccttcgcccgccagctcatgcaccatctgccacagttcgcgccgtgagatagggtcaacgccgacgccgggttcatcgagcagcaacactttcggttcgcctaccagggtacaggccaggccgagtttttgtttcatcccaccggagagcttgcccgccaggcgtccggtaaacgggccaagagatgtaaactccagcaggcgagcaaaagtctgcttccgtgcctcgccggtgacgctgcgcaaatccgcgtacagattgagattttccatcaccgtcagatcttcatacaggccgaatttctgcggcatatagccgagcacggcgtgcagcgcagcgtcgtttttgatcggatcaaagccaatcaccgtggcactgccgctgtcgggtttcagtaatcccgccagcatccgcatcagcgtggttttgcccgcaccgtccggcccaaccagccccgtcacataaccggcgtgaatggtgcagtcgagcggtgcgacggcgggcttgtccatgcccggaaagcgtttttccaggccgttcagcgtgataacggcatcattcatgtcctgcctcgtcaccgaattgcaccgttaccggcattccctggcgtaacgcatcatcggcgtcggtcaccacaatacgcaggcgatagacgaggtcggtacgcagatccggtgtttcgacggttttcggggtaaattcagcagtcggcgaaacgaaaccaatctgcccgtgatacggtttgttcggacgaccatcggtataaagcagcactttgcgccccggctgggcctggtcaagattacgttcatcaacataggcgcgtacccacaccggacgcgtcagcgagacggtaaataccgtgccaccttcattaagcaccgtgccgggctctaccgcgcgcgttaacagcgtgccatcagacggtgctatcaacgttgagtcctgcaaattcagctccgcctgcgccagttgcgcctgcgcttgttcgaggctggctttcgcctgggcgatgtcctgttcgcggttaccggaacggtactgacgcaatttatcctgcgctgatttcagcgtggcctgcgcctggtcgcgcgaggagcgggcattttccaggtcatttgccgaaatggtgcggcttttccacagtccttgctggcggttatagaagttctgcgcatagtcataggcagcttgcgcctgtttcaccgctgcggcggcctgagcgatttcttcatcgcgatacccggcaagcatcaggtcatactgcgcctgagccaccgaaacgcccgctttcgcctgcatcagggcaatctcatacggcttgtgatccagttcgcccagcacctggcccgctttgatcgcatcaccttcgtccaccgccagcgactcaacgcgcccccctacacggaaactaagattcaccgtacgaatatccacgttgccatacagcgtcaggccgttatcctggcggctttgataccaccagtagcctccggcaaccacggcggcaagtactactaccgccagtccgatcacgacaggttttttcatcactacaaactcctttgcgataatccttgcaaaatcaggtcaatatgacaggtcaccgtctggttgatcagttcggtcttttcttcatcgaacgcggtccagccggtacgtaacagaatagtttctttgccaagacgaaacgccagaatctcaccaatcaacgcatgggtatgaaggatcatgcgggtatcgctagcgtcgcagccggtccaggcggcaatcaggcgtgtaaggtgactgtgtagcggactaatcacctgttcgtgcaccaggtggtaggctgccgtgggagagagctgctcacgggagataaatttgctgaggttgacggtgtcatcctgggtgagcagcttaatcatgtttctgcaggcgcgaaggatcagttcacggatggctgcccgatccggctgtggttgtgcgaacaaacgttcggcttcttcggcgtgtggacggaactgctcgccaataaaatcagcaatccactgggcgcaggcgaggtacaaatcttctttcgaaccgaagtagtaggtgatggctgcgatattctgcccggcctgggcggctatctcgcgggtggtggcgttcattccatattcaccaaactgtgccagtgccgcagcaatcagctgttttttcgcctgttcacccttgattgtcatggcaggattattcatcgcacagtccattcttaatcaaatgattgattaagattatgactccataggggagttgtccagtatggctaagaattttagctacgccagtcacagggataatttatgcgctgcgtcacaaaaactgctacactccgctccctcatgacattgtggtttttgtcattttccttttcagtatctccctgaaaactacaccggtaacggtcggggcggttcggagtagttatgtctttcgattctttgggtttaagccctgatatcctgcgcgccgttgccgagcagggttaccgtgaacccacccctattcagcagcaggcgatccctgcggtgctggaaggccgcgacctgatggccagcgcccagaccggtaccggcaaaacagcgggctttacgctgccgctgttgcaacacctgatcactcgccagccgcacgccaaagggcgtcgtccggtacgcgcgctcattcttaccccgacccgtgaactggcggcgcagattggcgaaaacgtccgtgattacagcaaatatctgaacattcgttcgctggtggtgtttggcggtgtcagcattaacccacaaatgatgaagttgcgcggcggcgttgatgtgctggtggcaacgccgggacgtctgctggacctggaacatcaaaatgcagtgaagctggatcaggttgaaatcctcgtccttgatgaagctgaccgcatgctcgacatgggctttatccacgatatccgtcgcgtgttaacaaaactgccagcgaagcgccagaacctgttgttctccgcgaccttctctgacgatattaaagccctggcggaaaaactgttgcacaacccgctggaaatcgaagtggcacgccgcaatactgcgtctgatcaggtgacccagcacgttcactttgtcgataagaaacgcaaacgcgaattgctgtcgcatatgattgggaaagggaactggcagcaggtgctggtgtttacccgtaccaaacatggcgctaaccatctggctgaacagcttaataaagacggcatccgtagtgcggcgatccacggtaataaatcgcaaggtgcgcgtactcgtgcgctggccgattttaaatcgggcgatattcgtgtactggtggcaactgacatcgctgcgcgcggtctggatatcgaagagttgccgcacgtcgtcaactatgagttaccaaacgtaccggaagattatgttcaccgtatcgggcgtactggccgtgcggcggcaactggcgaagcattgtcgctggtgtgtgttgatgaacacaaactgctgcgtgatatcgaaaaactgctgaaaaaagagatcccgcgcattgcgattccggggtatgagccggacccgtcaatcaaagccgaaccgatccagaacggtcgccagcaacgtggcggcggtcgtggacagggcggtggtcgcggtcaacagcaaccacgccgtacggaaagtggtgcgaagtctggtaacgcgaagcccgcagaaaaaccgtctcgtcgtctcggcgatgccaaaccggcaggcgaacaacaacgtcgccgccgtccgcgtaaacctgccgctgcgcagtaatcttttatgccgggctatgcccggcatgagactgatgacaaacacaaaactgcctgatgcgctacgcttatcaggcctacgtgaactctgcaatatattgaatgtgcatgtttttgtaggccggataaggcgctcgcgccgcatccggcatttcacaacaagcacttgtcagccatttgcgagcgcggcaaaaagatttctctgttttaacgcccacaagccacccgatgcgttacttctccgcagccaattgtccgcgcaacgccattaaaaggtaccccaggcgattcttgccctgaccattaccgccatctccccagtaagcatcattttgcgtatgctcaaccagttttgcggacgcggttgcccgcaagagtgtacgcagttctgcatgttgttcgaatttagcgcgaagcgctttacgcatcatcctgctggttattgcgagccgctttcccgaaacagaaaaaccattacccctgaaaaccgaaaaatgccacaatattggctgtttatacagtatttcaggttttctcatggcattaaccgccgcgcttaaagcgcaaattgccgcctggtataaggcgcttcaggaacagatccccgactttattccccgtgcgccgcagcggcagatgattgcggacgtcgccaaaacgctggccggagaagaagggcggcatctggcgattgaagcccctaccggcgttgggaaaacgctctcctatttgatccccggcatcgccattgcccgcgaagagcaaaaaacgctggtggtaagtaccgccaacgtggcattgcaggatcagatctacagcaaagatttaccgctgctgaaaaagatcattcccgatcttaaattcactgccgcttttgggcgtgggcgctacgtttgcccgcgtaatctgacagcgctcgccagcactgagcccacgcaacaggatctgctggcgtttcttgacgatgaactgacgccgaacaatcaggaagagcaaaaacgttgtgcgaagctgaagggcgatctcgacacttataaatgggatggtctgcgcgatcatactgatatcgctatagatgatgatctctggcgtcgtttgagtaccgacaaggccagctgcctcaaccgcaactgttattactatcgcgaatgcccgttttttgtcgctcgtcgggaaattcaggaagcggaagtggtggtggcaaaccatgcgctggtgatggcggcgatggaaagcgaagcggtattgcctgacccgaaaaatttactgctggtgctggacgaaggtcatcacctgccggatgtggcgcgggatgcgctggagatgagcgccgaaatcaccgcgccgtggtatcggctacagctggacttgttcacgaaactggtcgctacctgcatggagcagtttcgcccgaagaccatcccgccgctggcgatccctgaacgtttgaatgcgcattgtgaagagttgtatgagcttatcgcctcgttaaacaacattctcaatctctacatgcctgccgggcaggaggcagagcaccgttttgcgatgggcgaactgccagatgaagtgctggagatctgccagcggctggcaaaactcaccgagatgctgcgtggcctggcggagttatttcttaacgatttaagtgagaaaaccggcagccatgacattgtacgtctgcatcggttgattttgcagatgaaccgcgcattggggatgttcgaggcgcaaagcaaactctggcggctggcgtctctggcgcaatcttccggtgcgccggtgaccaaatgggcgacgcgggaagagcgcgaagggcagctacacctttggtttcactgcgtgggaatacgtgtcagcgatcagctggaaaggctgctgtggcgcagtattccgcacattattgttacctccgcaaccttgcgttcgctgaacagtttttcgcgtttgcaggagatgagtgggctgaaagagaaagcgggcgaccgttttgtggcactggattccccttttaaccactgtgaacagggcaaaattgttattccccggatgcgcgttgagccttccatcgacaacgaagagcagcacattgccgaaatggcggcctttttccgtgaacaggtggagagcaaaaaacatctcggtatgttggtgctgtttgccagcgggcgtgcgatgcagcgctttctcgactatgtgacggatttacgcctgatgttgctggtgcagggcgatcagccacgttatcgcttagttgaactgcaccgcaaacgcgttgccaacggtgagcgtagcgtgctggtgggcttacagtcctttgccgaaggtcttgatctgaaaggcgatctgctcagccaggtgcatatccacaagatcgcttttccgcccatcgacagcccggtggtgatcaccgaaggtgaatggctgaaaagcctcaaccgctatccgtttgaggtgcaaagcctgccgagcgcttcgtttaacctgattcagcaggttgggcgactgattcgaagccacggttgctggggggaagtggttatctacgacaaacgcttgctgaccaaaaattatggcaagcgactactggatgcattaccggtatttccgatagagcaaccggaagtccctgaaggtatagttaaaaagaaagaaaaaacgaaatccccacgccgtcggcggcgttaatgatgtgagtcaggtaaggagtcgtaaatggactatcgcaaaatcattaaagagatcgggcgcgggaaaaaccacgcgcgcgatttagaccgggatactgcgcgcggtctgtatgcccatatgctcaatggtgaagtccctgaccttgagttgggcggcgtattgattgcgctacgtatcaaaggggaaggggaagcagagatgctcggcttttacgaagccatgcaaaatcacaccatcaagctgacgccgcctgcaggcaagccgatgccgattgtcatccccagttacaacggcgcgcgtaaacaggccaacctgacgccgttgctggcgattctgctgcacaaactcggttttcctgtggtggttcacggggttagcgaagatccaacccgcgtgctgactgaaaccattttcgaactgatgggtattacgccaacgttgcacggcgggcaggcgcaggcgaagctcgacgaacatcaacctgtctttatgcctgtcggcgcgttttgcccgccgctggaaaaacaactggcgatgcgctggcggatgggcgtgcgtaacagtgcacataccctggcgaaactggcgacgccatttgccgaaggtgaggcactgcgtctttccagcgtttcgcatccggaatacattggacgcgtcgcgaagttctttagtgatatcggcgggcgggcgctacttatgcatggtactgaaggtgaagtgtatgctaatccgcagcgctgcccgcagatcaatctcattgaccgtgaagggatgcgggtactgtatgaaaaacaggacactgctggtagcgagttactgccacaagcaaaagatccggaaaccacggcgcagtggattgagcgttgccttgctggcagcgaaccgattcctgaatcgctgaaaatccagatggcttgctgcctgatggctacgggtgaagcggcaactatcaacgacggcctggcgcgcattaatcaggcattttaatttttatctcagccggatgagccatgtcatccggcttttaccccaccgcaatatgaaattcctgcatctttattgaccttcccgcgcccggcgtgcagcataaaaaaacaacaaacacataacataaacaggagttaaccatggaaagtggtcatcgctttgatgctcagacgctgcacagttttattcaggctgtatttcgtcagatgggtagcgaggaacaggaagcgaaattagttgccgatcatttaatcgcggcaaacctggcagggcatgattcacatggtattggcatgatcccaagctatgtgcgttcctggagtcaggggcatctgcaaattaatcatcatgccaaaatcgttaaagaggcgggggcggcggtcacgctcgatggcgatcgcgcatttggtcaggtcgcggcacacgaagcgatggcgctggggattgagaaagcgcatcagcacggcattgccgccgtggcgctacataactcgcatcatatcggccgtatcggttactgggcggagcagtgtgcagcggcggggtttgtctctatccactttgttagcgtggtcggtattccaatggtcgcgccgttccacggtcgcgacagccgctttggcaccaatccgttctgtgtggttttccctcgtaaagataatttcccgctgttgctcgattacgccaccagcgccattgcatttggcaaaacccgcgtcgcctggcataaaggcgtccccgtgccgccaggttgcctgattgacgttaacggcgtgccgacgaccaatccggcggtaatgcaggagtcgccgttgggttcgctgttgacctttgccgaacataaaggctacgcccttgcagcgatgtgtgaaattcttggcggggcgctttctggcggtaaaacgacgcatcaggaaacgttacaaaccagtcccgatgccattcttaactgcatgactactatcattatcaacccggaactgttcggcgcgccggattgtagtgcacagaccgaagcctttgccgagtgggtgaaagcctcgccgcatgatgaagataaaccgattttgctaccgggcgagtgggaagtgaacacgcgtcgcgaacggcaggagcaggggattccactggatgcgggaagctggcaggccatttgtgatgcggcgcggcagattggtatgccggaagagacgttgcaggctttctgtcagcagttagccagctaaaaaaaagcccgtccagtggcggacgggcgaacaagggtaacataggatcaatgagggttagagcatatgcgtctgtcggcaaacagacagggaaatacttgtgctgaacgtagcgtaaacgcctgatccagccaacggttcggattttgtaggtctgataagacgcggtagcgtcgcatcaggcatctgttgccggatgcggcgtaaacgccttatctgtcctacgaattacttataaattaccgcagtaccgcttaatttattgttgttggtggcggaagtaatgctgtatccactggcaccggccgccgcggctttctcagccagtttcgcttccagggcatcgagggtggatgcgccatcggcagaaaccacgccgattttattcatgttctgtgcctgggatgccgttaccggttccgccgcgaacacgccaaatgacagagttgaaagagccatagcagcaacaacagtattgatagttttcataattaatctctcgcaggtgatttttgtataagtgacgttgtttcgtcgatgtgatgagtatcacgtttttttacgagagataaaatcgaagagaattgaccgccttgttcaaataaattgattgatatctaacatactgataaaccatttatttgttgtatttatgaatccgttttgtaccgcgtggtgctcacggcagcgttaaaggcacggaatgccacgcaaaatacaaattacactcactaaacatcccgtcagttgcagttaacgtaactggctgtctttcgaacctctgcgattatatcctgtataagctggtttttgtaaatctttctcctgttggcaatgaatgcataagcgcacgccaggaatggcttcccgacgggcctgcgggataggggcaccgcactcttcacattcatacaggctttcgccacgcggaatttcaccccgagcgcgggcaatcgcatcttcaattgtactgttgatctgttcgttgacggcgtcatcattagcccaaccggatgccatatcgtcctccccatatcaatacttgtacagttaagtgtagctaatatagggacgaactcgggcagttcaagcgtcagatctccgaccattcccgcagcagattatgataaagattgagcagtgacaggatctcttcactttcgccgtagcggcttttcagcgactgaatattgttgtccagttcaaacagcatggcgcgctttttatcatcacggatcatcgactggatccacataaatgatgccactcgcacgccgcgggttacgggtgtcacgcaatgcaggctgctggagggatacaacaccagatcgcctgccgggagttttacccgatgttgcccgaaggtgtcattaacgaccagttcgccgccgtcgtagctttctggatcgcttaaaaacagcgtggcagaaaggtcagtgcgcatccagccgttttgtggatggctgcgtactgcgccatccacatgaaaaccataggtttcattgttctgatagcgattaaacagcggcgtggaaagggtacgcggcaaggccgcggcaaagaacaaagcatgttggttaaccgcgttcagcacctcattttgcagggcggcgtacagggcgctgcgggtgtctacttgttgattgttcttaacttgcgcaccttgtgcgccggtggtgacgcgcccatccacccattcggcttgttccaggtgttcgcgaaaacgggcgacgtcctgtggcgataacacgccgggaatgtggtacatcatacaagttctccaaaaagtggggcctgcgccccacaccgatttttaacagcaggcaatggtgctcaggtgccggatgcggcgtgaacgccttatccggcctaccaaatgatgtgaattcagtgtattgcacaaccttgtaggcctgataagcgcagcgcatcaggcagtcctgctctcgccatcaacattagtgagccttgcgccccacatctgaatcagaaatgcatattagctgtgagcaagaaggttcttggctcgcccgggtgataacggtagccgctcttattgattgaggcgacgtaatcggtatcaaacaggttgtagacgtttagctggaagtcgagattgcgattaacccgataccccagtttggcgtcggcgacccaataaccttcggtaaacgctggcgttcccaccgcgccgtctgaacctttatgcatactgccgatataccgtgcgcccgcaccaacagaaatatcatcggttgcctgatactggctccataaggtgaaggcgtgttccggggtatacggcagcgatgaggaaccatcctgggcaacatctttgccgtttttgatagttgctttttgctgggtatagccgccaatcatctgccatgcgggggtgatattcccggccacggatatctcgtagccttcgacacgtttcttaccatattgcgaataagtcccgtcatcattttgctcaacttcattttcaatatcagtacggaacagcgcggcggtaagtagcaggcgtttatccagaacctgccatttggtgccaatctcgctggtgttggctttttgtggtttaaaatcggtgcggttggcactgttaccgctgccagactgcgcaagggcgaagttgttgccgcccggcggctgctgggaaacggcatagttaatatagacattgccgttttccgtcaggtgatacagcgccccggctttccagttcaccagattgcccgacttggcggtgtcgacggtggtgaccggagaaccttttgccacgccagcagggcaggtgatggcaccgcgcccgctgccgccgcaggcggtagcactgtcatattcagtatgataattatccagacggatcccgccgttcagctcaaaatcacgggtgatttgcagcgtatcgaaggcataaattgcgaaggtatccgtctgaccattggcgtttgcgccgttgcgcgtcaggccgccgggatgaatgctgctgtcaggatgataaatatttaccgccggtaacgtcaccggattaacgccatagttagtctgtgtttcgcgggtaaattccacgccggtactgagatcatgaccgatagcgccggtatagaatgtcgaggtcaggttggtctggttggtgagaattttgttactcacatctttggtattcgccgtgcgtgaccacgtccagctattcacatcgctggtgggctgggtaatattcgacgctccacccataatcgccgtcatcaggtaatcctgctttacgcgcgaccaacgcgtagtgttgcgaatggtggcgttatcgttgatgtcgtgctcaaaacgcatggtagcggtgtcggtgatcgaatcgtcgtaatcggaatctgtgccgtaaaagttatgagtatcaacttttccggaatgattcagggctgctgttcccgcagatggggcagaataacccggtaaaccgatagtcggaatgccgccgtctggcgtgttgtgctgggtgacatgcagataattaagatacaaacgattcgctgtaccaaggccaaaagcgacagaaggggcgacgccgtaacgctcatttttgactttgtcgcgtccggcatcgtgcgttttttcgcccattacattcaggcgcaccgcagtggtatcaccaatgacctgattgacgtccagcgtgccgcggcggaaccaggcgctgccaatactggcggaggcgtcaatgccggaatcattgcgcggctgtttgctgatcatattgatcgagcctgtcggtgcgctgcgcccgtagtcggtgccggacggccctttaattacttcgacctgctcggtattgaaggtgtcgcgcgagacgctgccgatatcgcgaatgccatcgatataaatactgttagaggtatcggcaccgcgcatataaatggcgtcgccagtggtggagttaccgttctcacccgcaaaaaacgcacccacgccggggacgtttttgagcgcgtcggtaaggttggttgcaccctgatctttaatcacttgttcagaaatcaccgtcatcgtgcgggtagtatccgctaccggacgcgagaatttcggatcggcagattgttgtggcgcataaagcgaaggcgttgatgcttcgacaaccagcgtgtcatccgcgttagcttgcccttcggcagcgagtgcctgtgccacaggcgtaataccaatacaaagaccggcaaagaacgtgagcgaatgaaattgtctggcagggaaattgcgattgttttccattttgcaggtgactttttcttatatggtgaaattttcactgtcacgagaaagcatctctgcggatgcgatgccactgttaatcccgtgatagcgtacgtgcaagtgataataattttgataagcattattacttggcgcgattttctatcacccattgcgcgaaaaagaaatacatttatttacattgcgttcatatttgatgttttttgcttacaaatcggacgaaaactgcatccagagacgaatgcagttacgttggtggggttatttgtagatgattgcagtaccgaacatctggtcatttccgcctgcggaattaatgacataacctttcgcgccttgttcgcgcgctttttctgccagtttatcctccagatcgcttaggtttgatgcgccagttgccgaaacggtaccggcgggccgtagttgacctctgtccaggttactcatcggttgcgcggcataagccgtgagagagattccgctcaggacggtggcaatcagtagtgtgaggcactttttcataatgacatcctcataaatacaacgggtagtgccagataagtgtaggtcgcctgcgcgatgaaaatgacgtaaaaaattgacagagatgtgcttattttttgaacgatatgtttttacaaaataagacaaatcaatgacatgcatgatgatgatttttatggtgaattgccataaaccatagccatgtgaaggtttttagaaatgataaacgcagccagatatttaccctgtcgcgttatgcgggtatcttacgccgctgcttaaaggagaatgctatgtccgcccagaaaccggggttgcatccgcgcaaccgtcatcacagccgctacgatctcgccacgctttgtcaggtcaatcctgaactcaggcaattcctcacgcttacacccgccggggagcaaagcgtagactttgccaatccgctggcggtgaaggcgctcaataaggcgttgctggcccatttttacgccgtagcgaactgggatatcccggacggttttctctgcccgccagtaccgggccgggcggattatattcatcaccttgccgatttactggctgaagcaagcggaacaattccagctaatgccagcattctggatatcggcgttggtgcgaactgtatttatccgctgattggcgtacatgaatatggctggcgttttaccggtagtgaaaccagcagccaggcgttaagcagtgcgcaggcgatcatcagtgctaatccggggcttaaccgcgctattcgtctgcgtcggcaaaaagagagtggggcgatttttaacggcatcatccataaaaacgagcaatacgatgcgaccttgtgtaacccgccattccacgattccgccgctgcggcacgggcaggtagtgaacgtaaacgccgtaacctggggctgaacaaagacgatgcactgaactttggtggtcagcaacaggagttgtggtgtgaaggcggtgaggtcgcttttatcaaaaagatgattgaagagagcaaaggcttcgcgaagcaggtgatgtggtttacctcgctggtatctcgtggtgaaaacttaccgccgttgtatcgtgctctgacggacgtaggtgcggtgaaggtggtaaaaaaagagatggcccaggggcaaaagcagagccgctttatagcctggacctttatgaacgacgagcagcgccgccgttttgtcaatcgccagcgttaaagcgttggctcccccggcggcaacggttcagccggggccgcgcccggagctggcagcacctgataagtctgcaccggcgcgcgaacacccgccaggtcgaaatgttttttcacctggctgtcgagggcaaagcggaccgtccactgtttgagtggcagcgtggtgaacgaaacacgcagtgtaaacgcggtattgcttaagccgacaatcccggcaaagttcggttcaccaataaccagcccgcgaatttcttcgttttccatcaattctgctaccgcatctttcagtgcctgattggctttatcagcatcttcatggcgatcaacatcgtagtttgccactaccgaaccaataccgcggacgaagttagcaaaggtggttatcgaagaccacggaatgatgtgatacgccccggtatcctggcgcacgcccacggagcgaatcgacatccgttccacagtgccggtcaacggcccgatagtcaccaaatctccagtgttcatgccgttttcaaactgaataaatactccggtaataatatctttcaccagcgtttgcgaaccaaacgagatagccagacctaatgccccggcacctgccagcaatggcgcgatattgacgccgatttccgacaacacaatcatgatggtgatggtactgataatcaccgccagcgcgttacggaacagcgtcagcagggttcgcgtacgggcgctgggtagcgggcggccatgaatatccgaagccagccggttttctatcaaactggcgagcaccgtccagccaaccgccgagaagaaaagaatgagtgcgatacggatcaggatatctacggttttctgccccgctccgttttgcagccagttccagaaatcgaacaatccccatgcgctcaacagcagcattaccgccacgcagactgtcagaatacgcgctgttttcagtgccgccgaaagccatccattcagccgtttttgcagctcgggatagttacgctgagtatgtggcgagagggtgatggttttcgccaaccagcgggaaaacataccggaaacaaatgctgcgacaccaataatcgccaggctgcgcaccgttgcacccatcataaatttcaggctgttgcccggatcgaacaacgaaaagaaaaacagcacgataaaataggcgcttgccagccagtgccacaccagcgcaaaggcgcggataaacaggctgaaaaaggccagcgaatgctccgcaaagttgagcaaatgctgggtgatctcttttttattacgaaaaatcaggtacaacgcccagacggtcatgcacagcataatgatgacgttcgccagcgcacctatctgtacattcacctgattagagataatcggcacagccacaatcagaccatagccaatcaggctgcttaaccagctcaggcgacgactccagtaacgggcggtctcgtcatgaatcgtgaacgggcgcagttcagccacgtttgggcaaaaaatcaggcgtagtacggctttgaaaaattcaatcagggcaaaggcgttgagaaacaaactttgttggaaagcgatggtgcgactgcccgcattcaggttgtcgcttaaaacctgaccgacaaataatgtcagtgccagtaacagcaggtcgataataaacgccccgataatcatcgccggaagctgcaaccagttactgcgctcacgatttttttgccgcgcccactggcccattttgcgatacagcggaagtgcgcacaggcgaatcagccagtaaaaaccaaacactaataccgctaacattgaaaaatgggtcaacgcattgctgaaggtttgtggattaaacggcttatgcggggagccggtgatattgcgataaagttgtccgaagcgggcggaaagggcttcaccataatggcggctgacttcggtgactttttgcagcacggtttgctcttcaaccagcgtcggcggcacgatcttcggtacgggttccgcagggggcgtcgcggcgacggtgcgcaactggtcgatcaactctttacgcgaggtgtcattatccagcacatccgccagtgcgccataggccgcttttttttgttcgatatccggttccggggccggttcagtcgttgagtccgttgtcgttgtggttgtaacgccgggtatggataccgcgtgggcaggtgcgcccaacaggcagaagaggatgaacaggatccaccgcatgactcctccagtgagaaaacagagcaaaaagataagtatagatgctggaggctgggcgattttaaatgagaggaatctggtgtgcctccctttcgggggaaagggaggcagagaagttaagagacgtgctgcaaaaattcctgcaagcgctggctcggcgggttcttgatcaacacctgcggatcgccatcttctgcaatccggcctttgtcgataaagatcaggcgcgaagctactttctcggcaaaaccgatttcgtgggtcacgatcaccatcgtcatcccttcttcagccagatcctgcataaccttcagcacttcatggcgcagttccgggtcaagagcggaagtcggttcatcaaacagcatcattttcggcttcaccgccagcgcgcgggcaatcgccacacgctgctgttgaccaccagaaagttcggaagggtagtgatgtgcacgctctgccagaccgactttcgccagcagctcacgcgccagtttttccgcctcttctttattcgcgccacgcacgcgtagcgggccaaacatgacgttttccagcgccgtcagatgcgggaagaggtaaaactgctggaacaccatacccgcttcctggcgaatcaggcgctcatcaactttcggatcgttaaccttcaggccatcgacaatcagatcgccggaggtgatttcttccagtttgttgatgcagcgcagcagggtcgatttaccggaaccggacggcccgataatcaccacgacttcgccctgagcaatgttcaaatcgatattgtgcagcacctgggttggaccaaaatgcttggagacgtttttaaattcaatcacaggattttcatccttctttccagacgacgcagaataaagctcagcaccagggtaataatcagatagaacaccgccacggcgctccagatctcaagggcgcggaagttaccggcaataatttcttgcccctgacgggtcagttccgccacgccgataacaataaacagcgaagtgtctttaatgctgatgatccactggttacccagcggcggcagcatacgacgcagtgccagcggtaaaatgacgtagcgaatggtttcccaacgtgaaagaccgagcgccagtcctgcttcacgaaaacctttgtgaatagacagcaccgcaccacgcgtgatttccgcaatgtacgcgccggagttgatcatgatggtgaccaccgccgcagtaaacgggtcgatgcgtaaatcgttaaacgccatcggcagggcgaaatagataaacatcacctggacgacgataggtgtgccgcggatcacttcaataaagaccagcgcgacgtggttggctatccaaccaccgaaggtgcgtgcaaaacctgccaacaatccgatcaccagaccgccagccagaccgaggaccgaaatccacagggtcattttggcaccttcaatcagaagcggaatggcaggccagatggcactccagtcaaactgcatatgttgttcctgttaccgtggtgtaaataatcaaattcagggtaattaatggccccggagcgggtttgcgcccttcaccctaatcctctccccggcggggagagggaactgccagtgcgctttacaggcgcagcgttattatttcggttcagtaccgaaccattttttgtagatttcgttgtaagttccgttctcgcgcagggttttcaacgcgccgttgattttgtcacgcagctcgtcgctacctttcgggaacgcaataccgtattgctgtgcttccagagagtcacctaccgctttgaactgaccgttaccggcggttttgatgaagtacagaatgtttggcgtatcgtgcagaacggcgtctgcgcggttggtgcccagttccatataggcgttatcgatgttcgggaactgacgcagatctttagttttgatgtttgctttcgcgtaatcaacggagccagtgccgctcttcacagcaaccactttcccgtcgagatctttcacgcttttcacatcgttattgttagctttcaccatcactaacaggccgcttttgtagtagccgtcagagaaatcgatcgcttttttacgctcgtcggtgatggtaatgcccgccagcgccagatcgacgtttttggtttgcagtgctggaatgatcccactgaaatccatcggcttcagttcgtaatccagcttcagttctttagcgatggcagcccacagatcaacgtcaaagcccacgtatttatcgccctgtttaaattcaaacggaacgaaggcagtatccgtcgcgacaactaattttttatccgcggcatgagaagaaaccgcaaaagccagggtcagtgcagccagtgaaacttttaatacagacttcatagcatttccttttttctatccacgggacgatcccctgcgtgacattcacatatatgaaaaaatcgtgccagttttgcaactcattgatttttcgagatgcggcaaaaacgtgatgcacgatttatagggcaataccctgaagatgcaccattctggggcaccaaactggtgcgctaaaattgtgcactcaacacagtgattatttagcgtaaaacatgatgaaaaaacaatctttatgtaacgattgtgtgatgatgtggatacaaaaaatttacttaaccagcaggggatagcagatggatgcactaaataagtgcgttgaggcgggctacaaaacaaaacggcctcctgtcaggaagccgcttttatcgtgtactaaagttctgcaccatcagcgatggatttattcgatgttagactcgataaaccacaggaatttatccaggtcgcgagacgcggcggtcaggatatctgcggtgtcgtcatctttcgcttcgccaatcgctttgcgtacgtcattagcgacgattgcgtaacggtcagccagctctttcaggtgatcctgaacgttgtggatgtccagcgggtaacttttcagcggagttttgctgttgataacttgagtggtccccagagctacaccgcccagctgcactgcacgttctgccatggtatccagatgatcgatcagtgcagtgcggaagccatccagcatttcatgtacggcaatgaagttagcgccgcgcatgttccagtgcgcttgtttggtaatcaaagaaagatcaataaactggataacctggcgattcagcaactctactgttgcttttttctcgctgtcagagacatcgttgcgggtataaagcagattggtcgcttttgatttaactaatttagcggtactcataatttcatatcctcttgatgttatgtcccagtaattaacgagactaagtatagcaccagctatgtgttccgctattctggctgttcctatcacactaatagtggtaacaagcgtgaaaaaacaaaaccaataaaaactcaatgagttagatatattaataagaacaattcctatttgtttgctcgctaggaattttcggaataaatatgcttttgcataattcgatatataaagacggcgtagaggaaaagtagcgagaaaatctgcatggttatgcataaccatgcagaaatgtaaatttaatttatgtctaattcttttattttgctctctttgcgtactgtcagcgtagaacccattgaagcggcgatgatagcgccgagcgccagcagctgtatgggtgtcagtgtttctccgaggaaaatcatcccggaaacggcagccagcgccggttccatgctcattagcgtaccaaatgtgcgtgttggcaaacgggtgagggcaatcatttccagcgaataaggcagagcggtcgagagaatagcgacagccagacccaatggaataaccgaccagtgccagagtgcttcaccagcctgaagcgttccaattggcacgaaaattaacgctgcaatcaacgaaccaattgccaccgtcgcagggccatgttccgctccagcacgttgcccacttaaaatgtaaatagcccaacaagccccggcccccagtgccagcgcacagccggttaaatcgacatgggaaacgtcttgccccagcggtagcaggaaccacagaccaagaaccgccagcacaactcagacgaaatctaccgggcgacgagaagagaacagtgccaccgccagtggtccggtgaactccagcgccaccgcaatacccagcggtaccgtctgaatagaaagataaaaaagataattcattccacccagcgaaacgccgtaaaacaacagcggtaatcgttgctctttggcaaagcgcagtcgccatggcttaaagaacgcgatgaggatcagcgtgcctaatgccagacgcagcgcagtgacccccggtgcgcccaccagaggaaaaagtgacttagctaacgaggctccaccctgaatagacgccatggcaacgagcaatatgactattggtaaccagaccggcattttacgtaatgaaccaggcatcctttctcccacaaatatctaaacctaagtaaagcgtggagtgtactggatatacccaatgctggttgagcatttgttgaaaaaattttcccccgttttgactaaaatgcgccaggattgatggaatcattagtctggtgattaggaataatctggatgaatgacagggaaaacatgcgtaatacttacgcagttctctgaaaaagtgatttaaatttagatggatagcggtgtatggaaacgttctgttacatgaaatggcccgttagacatcataaatcgcgaagagtttcccattaatttttgatatatttaaaacttaggacttatttgaatcacatttgaggtggttatgaaaaaaattgcatgtctttcagcactggccgcagttctggctttcaccgcaggtacttccgtagctgcgacttctactgtaactggcggttacgcacagagcgacgctcagggccaaatgaacaaaatgggcggtttcaacctgaaataccgctatgaagaagacaacagcccgctgggtgtgatcggttctttcacttacaccgagaaaagccgtactgcaagctctggtgactacaacaaaaaccagtactacggcatcactgctggtccggcttaccgcattaacgactgggcaagcatctacggtgtagtgggtgtgggttatggtaaattccagaccactgaatacccgacctacaaacacgacaccagcgactacggtttctcctacggtgctggtctgcagttcaacccgatggaaaacgttgctctggacttctcttacgagcagagccgtattcgtagcgttgacgtaggcacctggattgccggtgttggttaccgcttctaatcacttcggtgatataaaaaatccgcctctcggggcggatttttttgttttaaggtttcgggtcgaaaatatcggttccgagatggttgtaatccaccttctgtaactggaagttggtgatgtatatcggcccggctttcttctcagatataaacgggtatttgatatttatttccttcgctttaattcccgtccactgcgagaaaaagcctaagaagtcattggccgagcggcgggctttaatcacccgatgcgctttatcgtcgctggaaatgaccataaaaggcacctggaaattttgctgatacttatcatcatgggcaaggtattgcacgtctttgccgcgctctttaaaggccagaccgtggtcagaaaagtaaaccagcgagaagctgctgccgctgttgcgtaactgatcgtacagcttgcgcagtaaatcgtctgtttgcgtcatggtatagagatagcacgacgtttctttcgattgcacaaaggtttcgtattttccttgtgtccggtcgcaggcctgcggatgcgagcccatcagatgtagaacaatcagctgcggttgcgagtgctcttgcgccagcacttgagcggtcatatccagtaacgcttcgtctttcgtgtttttatctgcttcaaaattaccttctttcaggaagtacacttcatctgctcgtttggcgatgctggcgatggcggtatcgtattcgccgatttggccctggttggaaaaccaccaggtctggaagcccgcgcgatttgccagggtgacaaagttatcctgaaactgtggtttgccatcgacaacgcgattgagcgttaagccaagcgatttctgcgtggagccactggcggcaatgtagtcagcaaatatcaaaccgttaacgctgctggcaaacggggtattgtcccagtgaccgccaaaggcaccgagggcatcgcgacgcgcgctttctccgatcaccaccacatagatctgatacttcggcttaacggcagtgaccgtccaggtatctttcattccggaaagttttgccatccgttcttgctcttcaatcacctcgttattattgacgatgacatccttagcaaaacgaaataccggatagccagtatctttcagtttaaatacgccgccccaggccaggttttgcacgggagcaacaaaaaatgtcgccacactgaataccaggcacaggctgtcgaaggtattccagcgcgctttttcactctctttttttcgcctgattgctattacgccgagcgcaaaaataaatatgccgaccaggtagctgtaccacggaaaaatcgtcaggatttcggtcgactcttccatattggtggagtgcaatgccagcaatgtattgaagttaggcgcgccgtaggcctgagcaaaagggaaataacaagccgccaccagcgaactgataccgaccagaactttttgtacgcgaggcaatgttcgccatagcaaaagcaaaatagccgtaaacgcagcggtgtagagcaaactgaaggggtaacctaagccgaggttaattaatagcgactgtaaaaagtagaacgcagtccacgggctaaatacccggctacgggtaacaagcgattctttgagggttaaattcatatgccactatcgtaacaaacgccatgtgcttaccctggcgtcaagggtcaatacctgcaagagtgcgtgaagaggggaaaggggtccgcatccgcgagccgcaatatacgcagggctgcaagaagatagagcgagctgctgttcaggtcaactaccgacgaacaaatcttttgcgaaggggattgcaaatccgacaaaaagtggggtttttcagaccaaaacgcgttgtgcctgcataaaagcaggagtgaagcggcgtaccgcgacgccgctatttatcggaaggtttatcctgctgcggtttgttgttgaccatatcgcacaacatagagagcagcattaaccgtactttaaagggagaatgactaaacacgcgcatacacctcttgaactcattcataagacctcctgacttgctaatcccatcgatccttgagggatgattgcattacatacagatatagcacaggctatattatatagctattgctaaaacgttaattttttgtaccttcgcaactctggtttacaatgtgcgcacgaaatgagaacgctatgtatgcgtcaccataatgaggaagcacaatgagtcgtcgcgcaggtacgccaacagcaaaaaaagtgacgcagttagtgaacgtggaagagcacgttgaagggttccgccaggtcagagaggcgcatcggcgcgagctgattgatgattacgttgagctgatttctgacttgatcagggaagtgggggaagctcgtcaggtggacatggctgctcgtctgggggtttcgcaaccgacggtggctaaaatgcttaagcgactggcaaccatggggctgattgaaatgatcccctggcgtggcgtgtttttaacggcagaaggagagaagctggcgcaggaaagccgcgagcgacatcagatagtcgaaaatttcttgttggtgttgggcgtcagtccggaaatcgcccgtcgcgacgcggaaggtatggagcaccatgttagtgaagagacgctggatgcctttcgtttgtttacccagaaacacggtgccaaatgagcctgccttttttacgcacgctgcaaggcgatcgtttttttcagttattaattcttgttggcatcggattaagttttttcgttccctttgcaccgaaatcctggcctgctgctatcgactggcacaccatcatcaccttaagcggcctgatgctgctgaccaaaggtgtcgagttaagcggttattttgatgtgctggggcgcaaaatggtgcgccgttttgctacggagcatcggctggcgatgtttatggtactggcggcagcgctgctttctacctttctgaccaacgatgtcgcactgtttatagttgttccgctgactatcacgctaaaaagactgtgtgagattccggttaatcggctgattatttttgaggcgctggcagtcaacgctggttcgctactgacgccaattggcaacccgcaaaatattcttatctggggacgttctggtctttcgtttgccggatttattgcccaaatggcaccgctggctggcgcaatgatgctgacactcctgctgttgtgctggtgttgtttccctggaaaggcgctgcaataccatacgggggtgcaaacgccggagtggaaaccgcggctggtgtggagttgtctggggctgtatatcgtctttctgacggcgctggagttaaaacaagagctgtggggactggtgattgtggcggcgggctttgcgctgctggcgcgtcgtgtggtgctcagtgtggactggacgctgctgctggtgtttatggcgatgtttatcgacgtccatttactaacccaactgccagttttgcagggggtgttaagtaacgtgagtcatttatccgaacccggattatggttaacggcgatcggtttatcgcaggtgatcagtaacgtgccgagtaccattttgctgctcaattatgtgccaccgtctttattactggcatgggcggtaaacgtggggggctttggtttattacccggatcgctggcaaatttgattgcgttacggatggcgaacgatcgccgtatctggtggcgttttcatctttattcgataccgatgctgttgtgggcggcgctggtgggatatgttttgttggttatgatcccggcgggataaggtctgtcaaattaaaaaggcggattatgagtccgcctttgctttacgttttgaagattaattcagacgaaccggcatcccggaacgatttttgatcgcttcatccagaacaacctggtcaacatttggctgaccggtcactgtctgcacgctcttcgtcagggtaattggcacaatttcctgaccttcaaactgggcttcagtggtagacagcgggttatggacttcaatataacggctgccgtctggctcggtggtcgcttttaccggctcatcaataaactgtacgcgggtaccgaccggtactttctcgaacaggaatttgatgtcttcgttacgcagacgcacacaaccatgacttacacgcaggccgataccgaagttggcgttggtgccatggatagcgtacaggcgaccgatgtagagtgcatacagccccatcgggttatccggaccagccggaacgaccgccggaagcggttcgcccgcagcgcggtactctgcgtgcattttagcggtcggcgtccaggtcgggcctgcttttttacgctcaactttggtggtccagttgataggcgtgtctttgcctaactgaccaatgccgatcggcagcacgataacggtgttggtccctttcggatagtaatacagacgcatctctgcactgttaatgacgatgccttcatgaacggtatccggcaggatcagctgctgcggaatgttcagtacagtaccgcctttcggcaggaaggtatccacacccgggttcgcttccatcatattggaaagtcccatctggtactcggcggcaaaatactccagcggctgagtgttaccttcaggaatggtgatcacctgattctgaccaaccaggcgactcccgtcggttggcagaggataagttaccgcagaggcggtactgcaaaagccgacaacagcgaaggccgctgcgaataatgttttcaatttcatattcatgttaagcgagattttgtgcctggcaggccattgggttgagaatattagagtattggaagcgcattataagttcattccagctcacagtgaaatcagatgtgtacgaaatcacattttttgcctttggcttgagtgtagaccttaagcgaggagcaggatcttctttcagacttatggcataatgcgcggtttgtcatatctcttttcaggatacgcctgtgttagtttccagtaacgtcaccatgcagttcggcagtaagccgttgtttgaaaacatttccgtcaaattcggcggcggcaaccgttacggcctgattggcgcgaacggtagtggtaaatccacctttatgaagatcctcggcggcgacttagagccgacgttgggtaacgtttccctcgatcccaatgagcgcattggtaagctgcgtcaggatcagtttgcctttgaagagttcactgtgctggatacggtgatcatggggcataaagagttgtgggaagtgaagcaggaacgtgaccgcatctatgctttgccggaaatgagtgaagaagacggctataaagtggccgatctggaagtgaaatacggcgaaatggacggttactctgcggaagctcgcgctggtgaactgttgcttggcgtgggaattccagtggaacagcactacggcccgatgagtgaagttgctcctggctggaagctgcgtgtgctgctggcgcaggcgctgtttgctgatccggacattctcctgctcgacgaaccgaccaacaacctcgacatcgacaccattcgctggctggaacaggtgctgaacgagcgtgacagcaccatgatcatcatctcgcacgaccgtcacttccttaacatggtttgtacccacatggcggatctggattacggcgagctgcgcgtttatccgggcaactacgatgagtacatgacggcggcgactcaggcgcgtgaacgtctgctggctgataacgccaagaagaaagcgcagattgctgagttgcaatctttcgttagccgctttagcgccaacgcctcgaaatctcgccaggcaacttcgcgcgcgcgccagattgataaaatcaaactggaagaggtgaaagcctccagccgtcagaacccgttcatccgttttgaacaggataagaaactgttccgtaacgcgctggaagtggaaggtctgactaaagggtttgataacggtccactgtttaaaaatctcaacctgctgctggaagtgggtgaaaaactggctgtactgggtaccaacggcgtcggtaaatcaacgctgctgaaaacgctggtgggcgatctgcaaccggacagcggcaccgtaaaatggtctgagaacgcgcgcattggttactacgcccaggaccatgaatatgagttcgaaaatgatctgaccgtgttcgaatggatgagccagtggaagcaggaaggcgatgacgagcaggcggtacgcagcattctcggtcgtttactgttcagccaggacgacatcaaaaagccagcgaaagtgctttccggtggggaaaaagggcggatgctgtttggtaagttaatgatgcagaagccgaacattctgatcatggacgaaccgaccaaccacctggatatggaatccattgagtcgctgaacatggcgctggagctgtatcagggcacgctgatctttgtttctcacgaccgtgagtttgtaagctccctggcgacccgtattctggaaatcaccccggaacgcgtgatcgactttagcggtaattacgaagattacctgcgtagtaaagggatcgagtaagttattatcagtagccctgatatggtcagggctactgaaactgatgacaaacgcaagattgcctggtgcgctacgcttatcaggcctggtagtgtatcgcaatatattgaattttcatgattttgtatgccgaataaggcggttacgccgtatccgacataatgacatgcactttctcaataaactgaattggcgataatcaaagattaaacggcggtttattttccagcaccgtctgaatcacattcagcgcgccttcatgattattatcatcggtagcgtaacgggcgatttgtttaatgttttccgcagcattgctcatcgcaaaggaataacgcgccattttcagcatctccgcatcgttaccgctgtcgccaatcgctaccacattttgcggcgacagatcccagcgtttcagtaaccgcgaaataccgtttgctttatgtagaccgggaataatcaggtcgataaagccaaaaccactggtaacgggtttcataatgccatccagcgctatgtgcagtttgtcgatcactaacgggatttgttcatccggcaggttgagcgaaaacttgaacagtacgtcgtcaatctcctgataatcttttacaggtttcaggcgatggtagtgttttgccatcagtgcgacgaatgcttcgggggcattttcgctgacatatgcactttgcagaccgcaggcgacaaaattgagttgcttatcttttagcaactcgccaataacaatccgcgattcatgtcgggtcagttcgccgtggaacaactgcttgccatgttcgtaaaccagtgcgccgttttccgcgacaaaagagatctcatcctttagctcaggaaagaacgaaataagctggtaatactgattaccgctggcgacaacgaactcaatgccgcgctttttaagttcctgatactgcgccataaaacgtggttggttgtacgttttggcgtcgttaagaaaagtaccgtccatgtctgtgacgataacttttacgctcataggtgtgctcctggctcgaaaatgaaaccgtaacagtgtaataacaatgtgacgcagagcacaaattatatttcgaatgaaagtgagagcggaattgatgatgtgaatgatttgacccggcgacgacgccgccgggctgaggagattacagcatatgttcagtacgggcgatgatatcgtcctgagcgtctggagagagcgcggtgaagaaggcggaatagcccgcgacacgcactaccagatcgcggtactgatccggatgttttttcgcttccagcagcgtttcgcgggaaacgatgttgtactgaatatgccagcctttatgcacctcgaagaaggtgcgcagcaggatcatcagtttctgcttgtcagattcgttctccagcgttgctggattcagtttctggttgagcagcacgccgccgagaatcgcggccgtaggcagtttacccaccgagccaatgaccgcagtagggccgagatggtcagtaccggaggccggactagcgccttctgccagcggggtatgtgctttacgtccgtccggcgttgccatagtctgcgcgccaaacggtacgttagcggagatagacgatgtgcccgcataatagttgccgccaatcggaccacgaccgtagcgcgggttatggtactgcttcagttcgtcgatataggtctgataagcgcgagccagcagcgtatcgacagtatcatcgtcgttgccgtacttcggcgcaccgttaatcagccgctgacgcagctgctcgtgagtcaggccgtcgaagtcatccgccagtgcggcagccagctgttgctgaccaatcgcgccctgttcaaataccagtttcttcactgccgccaggctgttgccgaggttagcaatgccgacctgcaggccagaaacccagtcatatttcgcgccgccttgcttgatacttttcgctcgctcaatacagtcatcgaccagcgccgagcagagaatatcgtgtacgttctcttccagcatggtatcgacgacatattcgatttcgattgatttacgcgtgtagtaacggatttgcgtatcccatgcgtccattacttcatcgaagttgttgaagttacccgctgacaacgctttttcttgtggcaggaacactttgccgctggtggcatcacgaccgccttccagcgccgccagcatcacgcgggcgaagttgataaagctcatgccggtacagcgatagccccatttgccaccgacggcggtttcgatacaaccaatcgctgcatagtcgtaagcgtcctgcggttcaataccgagtttaataaattccgggatgacgatttcgtcgttgttgaacgccggcatcccgaagccgcagcggatcacctgaacacaggcgtcgaggaaatcgttactcatacccgcatggtaacgcacgctgaggttaggctgagtcgaacgcaggcgaccgcaagattcgaggatcgcataagagagtggatttaccgcgtccatcggttgaccatcaaccagattttgcccgccaatggtgacgttctgatacagcggacttcccgcagaggcttttgagtgtgagccggagcggattttgttcacttccagcaatttcaaccagcagctatgcagcatctcgatggcgtgttcgcgatccagtgtctggttcagttcaacgtcacggcgatagtatggatagagatactggtccatacgaccaaacgataccgagtgaccgttagattcgatctgcaaaatcaactggatgaagtaacatagttgcagcgcctgccagaaagtctgcggcggctggtgggcgataagatcgcagttttctgctatcgtcagcagttcatcgcgacggctttcgcgggtttcggtcgcggccatttcacgcgccagggcagcgaaacgttcaatgtgttcactgactgccaccagcacgatatcaatcgctttcaggaattgctcgccgtgcagatcttccagaaccgtcagattgatgtgcgagcgacgttccgccactttctcacgcagaccatcaagacctttttccagcagtagcgggaaattgaccgccaggtgcgcatcgccggaggtcatattgccctccgctttaatgattccggtcgccagcagacctttttgctcatcggtaaacatgccgtagcagcgatcctgtacggtctgaccgcgccaccacgggcacacttcatgcagaacgcgtttgttctcttcgctcaccgcaaaaccagcaccgggacgatctgccagatcatcaatctctttttcgatccacgagacggtatattccgggaagatcggcgcggcgcgaacttcgcttgcctggttgccaatgatcaactcatcgtgcttgatccagatggtgcgattcgccaggtgatgcgccagtgccagcgcgcgacgtaccgggattggcttatcgagatgttgttgatacatctcggtatagtgttgtgctcgttcggtacagaccggcggtttcacaatatgcaccagcgcatttttgtgcgctttaatgcggtcgctgagcgtatccagttttagtgttgtcatgattgttatcctcgtaaggtcgcggttaaccctttctggcaggcatactgctgggcaaagtcgagcagttctggcgcatcaagcggtttttccggggcgtcatagggcagattaagtaagtgatatttgttgatgcccagtgtgtggtagggcagaaaatgaatttcgctaacgtgcagctcgtcggcggcaaaatcggtaatggctttcacagaagtttcgtcggcattaaagccctgaatcagtggcacgcggataatgatttttttgccggctgcggcgagttttttcaggttatccagcaccctggcggcgttaccgtcggtccactgtttaaacggcgcgtcggcaacgtgttttaaatcggcaagaaacagatcgatatagggcagagaaggggcgatatatttccacggcacatgcagacaggtttctaccgcagtatgaatgccggcctcgtggctggcttgcagcagcgccgtcgccatttccggctgcataaacggttcaccgccagaaagcgttaagccgccgccgctgcgatcgtaaaacggtttatcgcgcaaaacggttgccatgatctcctcaacgcttttcacttcaccacacacggttaacgcctgtgtcgggcagcagtcggttagcgccgtaaaatgctccggggttaacttttcccgatgaataagcaaaccattcaacgcgcgctcaatcacttccggtgcggtcttagcgcacagcttacagccttccagacagagtcgtgggtcatacagcagatcctgcgtgcgggcgcggctttccgggttctgacaccagcggcagcccagcgaacagcctttaagaaatacgaccgtgcggataccggggccatcatgggtcgagtagcgttgaatattgaaaatcatagttgcctctctgtttcgttcaaacattaaaatattttcgaatgaaagttagattgatgtgcgtcaactgttcagagagttttcccgtgatagtctacattcagacaaaaagtacattttgaggatggttatggaactgtatctggatacttcagacgttgttgcggtgacggcgctgtcacgtatttttccgctggcgggtgtgaccactaacccaagcattatcgcagcgggtaaaaaaccgctggaggttgtgcttccgcaacttcacgaggcgatgggcggtcaggggcgtctgtttgcccaggtaatggctaccactgctgaagggatggttaatgacgcacgtaaattgcgttctattattgcggatatcgtggtgaaagttccggtgaccgctgaggggctggcagctattaagatgttaaaagcggaagggattccgacgctgggaaccgcggtatatggcgcagcacaagggctactgtcggcgctggcaggtgcggaatatgttgcgccttacgttaatcgtattgatgctcagggcggtagcggtattcagactgtgaccgacttacaccagttattgaaaatgcatgcgccgcaggcgaaagtgttagccgcgagtttcaaaaccccgcgtcaggcgctggactgcttactggcaggatgtgaatcaattactctgccgctggatgtggcacaacagatgattagctatccggcggttgatgccgctgtggcgaagtttgaacaggactggctgggagcgtttggcagaacgtcgatttaaccggacgttctgcatcctcataaattgctgatgacgtggcggagtgccgcgtcttatctggcctggaggtggcagttactgcccgcacacctcacaccccggattacgcatcagtttcatttcgcgaaactgacaggtcatcgcatcgtacatcacgattttcccgctggctggtttgccataacctgccagcagtttgattgcttccattgcctgcaacgaaccaattacgccgattaacggtgccatcacgcctgcttctacgcaggttaacgcgttctcgccaaacaaacggctaaggcagcgatagcacggttcgccgtcctgataagtgaagaccgtgatttgcccttccatacgaattgccgcgccggaaaccagcggcaccttcgcggcaaaacagcctgcgttcagttgattacgtactgcaacgttatccgtacagtcgagcaccagatcgtgttttgcaatcatcgcagcaagttcagcgtcatcaagcagcgcattgactggcgtaatcgcgatatgtgggttgatccgcgtcagggcgtcacgggcggattccacctttggttgcccgaccgtggcatcactgtgcagcgtctggcgttgcagattggagagcgaaaccgtgtcgaagtcgagcagcgtcaggttgccgacaccggcgcttgccagatactgcgaagctgcgcagccgagtccaccaaggccgacgaccagcacacgagaatcttttagcgcctcctgaccgtcaaaatcaaaaccgcgcagaatgatttgccggttgtagcgcagcatctcctgatcgctgagttctgccattacaggcctccgaacaacgcgttaaacggttcgacttccacccattcgcccacgtcaacattgccgcgctcgcgttccagcacgataaagcagttgccgaggctaaaggagctaaatatatgtgaaccctgatgtccggtggtcgtcacttccagttcgccatcggtgttgcgttgcagcacgccgcgctggaaatcaaggcgtcctggcgtttttttcaggcgggacgctgtgcgtacacgctggcgcgcgggcaggccactggcggtattgccgcttagttttgccagcaaaggctgtaccagttgatagaaggtcagcgtcgctgaaaccgggttgcccggcaggccgcagaaccaactattagaaagtttaccgaatgcgaacggtttacccggtttaatcgccagtttccagaaggcgatctcccccagctcttcaagaatcgttttggtgtaatccgcttcacccactgaaacaccgccggaactgatcaccacatccgcctggctgtcggcttcaataaatgcggcgtgcagggcatggggatcgtcgcggataatccctaagttgattacctcgcatcccaactgttctaacatcaggtgtacggcgagacggttggtatcgtagatttggccgtcgcccagcggctgaccgggcaactggagttcatcaccggtagaaaaaagcgctacacgcactttacgaatcaccggaacttcggcaatccctagcgaagcaatcactggcagttcagcggtagtcaggcgagtccccgccgggaaaacaaccgcacctgcagagatatcttcaccgcgacggcgaatattttgcccgctacgcgcttcagcagtaaaacgcacgccattgtccgtttgttcagtctgctcctgcatcaccaccgcttcgcagccttccggcaccggcgcaccggtcataatacgaatgcaggtacccgcaggccattcaccatggtacggctgaccggcaaaggatttaccggcaacgggcagcggttgcccggaggcaatatcggctaaacgcaccgcgtagccgtccatagcggagttatcaaaccccgggacatccagtggcgaaacgacatcgctcgccagaatacggccaaaacactgaaccagtggcagcgtttcctgggcggtcagtggggtaacgcgagaaagcatctcattaagcgcggtgtcgagcgacatcaatccggtggtaaattccatgaaaacactcctgcggaggcaaaatcgaatttgcctattatgtcagaaaaacgccacagactgtatgccacctcgggcgtagcgctggctcctgcctttacatgccatatccatctttctatattcaaaaattgaatgagtcattcataaaaattctgatatttatagcaaaagtggcgagccacccttaatggacgaatactatgggcaaagcagtcattgcaattcatggtggcgcaggtgcaattagccgcgcgcagatgagtctgcaacaggaattacgctacatcgaggcgttgtctgccattgttgaaaccgggcagaaaatgctggtagcgggcgaaagtgcgctggatgtggcgacggaagcggtgcgtctgctggaagagtgtccactgtttaacgccggaattggcgctgtctttacgcgtgatgaaacccatgaactggacgcctgtgtgatggatggtaacaccctgaaagccggtgcggtggcgggcgttagccatctgcgtaatccggttcttgccgcccgactggtgatggagcaaagcccgcatgtgatgatgattggcgaaggggcagaaaattttgcgtttgctcatggcatggagtgcgtctcgccggagattttctccacacctttgcgttatgaacaactaatggcagcgcgcgaggaaggggcaacagtcctcgaccatagcggtgcgccactggatgaaaaacaaaaaatgggcaccgtaggggccgtggcgttagatttagacggcaatctggcggcagccacgtccacgggcggaatgaccaataaattacccggacgagttggcgatagtcccttagtgggggccggatgctatgccaataacgccagtgtggcggtttcctgtaccggcacgggcgaagtcttcatccgcgcgctggcggcatatgatatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaagaggggacaccgttgccacacagtgatgaacttgatgccggtgatgtgctggcggttgaaaatctgaatattgcctttatgcaggagcagcagaaaatagctgcggtccgcaatctctcttttagcctgcaacgtggtgagacgctggcaattgttggcgaatccggctccggtaagtcagtgactgcgctggcattgatgcgcctgttggaacaggcgggcggtttagtgcagtgcgataaaatgctgttgcagcggcgcagtcgcgaagtaattgaacttagcgagcagagcgctgcacaaatgcgccatgtgcgcggtgcggatatggcgatgatatttcaggagccgatgacatcgctgaacccggtatttactgtgggtgaacagattgctgaatctattcgtctgcatcagaacgccagtcgtgaagaagcgatggtcgaggcgaagcggatgctggatcaggtacgcattccggaggcacaaaccattctttcacgttatccgcatcaactctctggcgggatgcgccagcgagtgatgattgcgatggcgctgtcatgccgcccggcggtgctgattgccgatgagccaaccaccgcgctggatgtcactattcaggcgcagatcctgcaattaatcaaagtattgcaaaaagagatgtcgatgggcgttatctttatcactcacgatatgggcgtggtggcagagattgccgatcgggtactggtgatgtatcagggcgaggcggtggaaacgggtagcgtcgaacagatttttcatgcaccgcaacatccttatacccgtgcgctgttagctgctgttccgcaacttggtgcgatgaaagggttagattatccccgacgtttcccattgatatcgcttgaacatccagcgaaacaggagccacccatcgagcagaaaacggtggtggatggcgaacctgttttacgggtgcgtaatctggtcacccgtttccctttgcgcagcggtttgttgaatcgcgtaacgcgggaagtgcatgccgttgagaaagtcagttttgatctctggcctggtgaaacgctatcgctggtgggagagtctggcagcggtaaatctactaccgggcgggcgttgctgcgcctggtcgaatcgcaaggcggcgaaattatctttaacggtcagcgaatcgataccttgtcacccggcaaacttcaggcattgcgccgcgatattcagtttatttttcaggacccttacgcttcgctggacccgcgtcagaccatcggtgattcgattctcgaaccgctgcgcgtacacggtttattgccaggtaaagaagcggctgcacgcgttgcgtggttgctggagcgcgtgggcctgttaccggaacatgcctggcgttaccctcatgagttttccggcggtcagcgccagcgcatctgcattgctcgcgcgttggcattgaatccaaaagtgatcattgccgacgaagccgtctcggcgctggatgtttctattcgcgggcagattatcaacttgttgctcgatctccagcgtgatttcggcattgcgtatctgtttatctcccacgatatggccgtggttgagcggattagtcatcgtgtggcggtgatgtatctcgggcaaattgttgaaattggtccacggcgcgcggtctttgaaaatccgcagcatccttatacgcgtaaattactggcggcagttccggtcgctgaaccgtcccgacaacgaccgcagcgtgtactgctgtcggacgatcttcccagcaatattcatctgcgtggcgaagaagttgcagccgtctcgttgcaatgcgtcgggccggggcattacgtcgcacaaccacaatcagaatacgcattcatgcgtagataacattcaggcggagaataaaatggcaagagctgtacaccgtagtgggttagtggcgctgggcattgcgacagcgttgatggcatcttgtgcattcgctgccaaaaatgtggtggtggcagtaggatcgaacttcaccacgctcgatccgtatgacgcaaatgacacgttatctcaggccgtagcgaaatcgttttaccaggggctgttcggtctggataaagagatgaaactgaaaaacgtgctggcggagagttataccgtttccgatgacggccttacttacaccgtgaaattgcgggaaggcattaaattccaggatggcaccgatttcaacgcagcggcggtgaaagcgaatctggaccgggccagcgatccggcgaatcatcttaaacgctataacctgtataagaatattgccaaaacggaagcgatcgatccgacaacggtaaagattactctcaaacagccattctcagcgtttattaatattcttgcccatccggcgaccgcgatgatttcaccggcagcgctggaaaaatatggcaaggagattggttttcatccggtgggaaccggaccgtatgaactggatacctggaatcagaccgattttgtgaaggtgaaaaaattcgtgggttactggcagccaggattgcccaaactggacagcataacctggcgtccggtggcggataacaacacccgcgcggcaatgctgcaaaccggtgaagcgcagtttgctttccccattccctacgagcaggccgcactgctggagaaaaacaaaaatatcgagttgatggccagtccgtcaattatgcagcgttatatcagtatgaacgtgacgcaaaagccgttcgataacccgaaggtccgtgaggcgctgaattacgccattaaccgcccggcgctggtgaaagtggccttcgcgggctatgcaacgccagctactggtgtggtaccgccgagtatcgcctacgcgcaaagttataaaccgtggccttacgatccagtgaaagcgcgcgaattactgaaagaggcgggatatcccaacggtttcagtaccacgctgtggtcgtcacataaccacagcaccgcgcagaaagtgctgcaatttacccagcagcagttagcgcaggtcgggattaaagcccaggtgactgcgatggatgccggacagcgggcggcagaagttgaaggtaaagggcaaaaagagagcggcgtgcggatgttctacactggctggtcggcttcaaccggcgaagcagactgggctctatcgccgctgtttgcctcgcagaactggccaccgacgctgtttaataccgcgttttacagcaataaacaggtggatgacttcctggctcaggcactgaaaactaatgatccggcggaaaagacccgcttgtataaggcggcgcaggatatcatctggcaagagtcgccgtggatcccgctggtggtagaaaaactggtgtcggcacacagtaaaaacctgaccggtttttggatcatgccagacaccggcttcagctttgaagatgcggatttgcaataagcaacgcagggagtggaatgcttaattacgttatcaaacgcttactggggttgattccgacgctgtttatcgtctcggtgctggtgtttttatttgtccacatgctgcccggcgatccggcgcgattaattgccgggcccgaagctgatgcgcaggttatagaactggtgcgtcagcagctggggttggatcagccgctatatcaccagttctggcactatatcagcaatgctgtgcagggggattttggcctgtcgatggtgtcgcgtcgtccggttgccgatgagattgccagccgctttatgccaacgctgtggctgaccataaccagtatggtctgggcggtgatatttggtatggcggcgggaattatcgccgccgtctggcgtaaccgttggccggatcgattgagtatgaccattgcggtgtcggggatctcgtttccggcatttgctctggggatgcttttaattcaggtattctccgttgaactgggctggctgcctaccgtgggagcagacagttggcagcactacattttaccctccctgacgctcggcgcggcagtggccgccgtgatggcgcgctttacccgcgcgtcgtttgtcgacgttttaagcgaagattatatgcgtaccgcgagggcgaaaggggtgagcgaaacctgggttgtcctcaaacacgggctacgcaacgcgatgatcccggtagtgaccatgatgggcttacagtttggatttttactcggtggttccatcgtggtggagaaagttttcaactggcccggacttggacgcttactcgttgactccgttgaaatgcgcgattacccggtgattcaggcggaaattctgcttttctcgctggaatttattcttatcaacttagtggtggatgtgctttacgccgccattaacccggctatcaggtacaagtaaggatgcgactatttaactggcgacgtcaggcggtgttaaacgccatgccactggtcaaacctgaccaggtacgtacaccgtggcatgaattctggcgacgatttcgccgtcagcatatggcgatgaccgccgcattgttcgttattttattgattgtggtggccatttttgcacgctggatcgctccctatgacgccgaaaattattttgattatgacaatctgaataacggaccttctttgcagcactggtttggtgtcgattcactggggcgcgacattttcagccgtgtcctggttggtgcgcaaatatcgctggcggcgggcgtgtttgccgtgtttatcggtgcggcgatcgggacgttgctgggcttgctggctggatattatgaaggctggtgggatcggctgatcatgcgcatttgcgatgtgttgtttgccttcccgggtattttactggcgatcgctgttgttgcggtgttgggaagcggcattgctaacgtgattatcgcagtcgccattttttccatccccgcgtttgcccggctggtgcgcggcaacacgctggtgttgaaacagcaaacctttatcgagtcagcacgcagtattggtgccagcgatatgaccattttgttgcgtcatatcttgcctgggaccgtctcttctatcgtggtgtttttcaccatgcgcattggcacctcgattatctctgccgccagcctgtcatttctcggcctcggtgcgcagccgccgacaccagagtggggggcaatgctcaatgaggcacgagcggatatggttatcgcgccgcatgtcgctgtttttccggccctggctatttttctgaccgtactggcgttcaatttgttgggcgatggtttacgcgatgcgctggatccgaaaattaaaggatagttacgtttgaatattgcttgaaagggtaatcacctcacaggaaattattgccctaagcaagtgttgtaactttctgctgattttgtagaatcgggtaatttggttaaaaagccgcagcaagggactattttgcagcggcacagcgttcagacagttattttgttaaatgtattaacatgctgagtttatacgaaaagataaagataaggctgataattttatttttattggcagcactgtcatttattggtctttttttcatcattgactatcaactggtatcggaacgcgcggtaaaacgtgccgatagccgctttgaacttattcagaaaaacgttggctatttctttaaagatattgaacgttcggccctgacattaaaggactcactgtatttattaaaaaatacagaggagattcaacgtgccgtgattctgaaaatggaaatgatgccatttttagactcggtgggactggtacttgatgataataaatattatctcttttcgcggagggcgaatgataaaatcgttgtttatcatcaggaacaagtaaatggaccgcttgtcgacgagtcagggcgggttatttttgccgattttaacccatcgaaacgaccgtggtcgatggcttcagatgactctaacaacagctggaatccggcatacaattgctttgatcgtccgggtaaaaaatgtatctcttttacgctacacatcaacggcaaagatcatgatttgttagcggtagataaaattcatgtcgatttaaactggcgatatctgaacgagtatcttgatcacatcagcgctaatgatgaagttctatttttaaagcaaggtcatgagatcattgctaagaatcaactcgctcgtgaaaaattgattatttataatagcgaaggtaattataatattattgattctgtcgatacggaatatattgaaaaaacatcagcggtgccaaacaacgcattattcgaaatctatttttattatcctggtggtaatttattgaacgcatcagataaacttttttatctgccgtttgctttcattattatcgtattgctggtggtttatttaatgaccactcgagtgttccgtcggcaattttctgaaatgacagatttggtcaatacgctggcgtttttgcccgactctacggatcaaatcgaggctctgaagattcgtgaaggcgatgcgaaagagattatcagcatcaaaaattcgatcgcggaaatgaaagatgctgaaattgaacgggcaaataaattgctctcgctgatctcttacgatcaggaaagcggttttattaaaaatatggcgattattgagtccaacaataatcagtatctggctgtggggatcatcaaactgtgtggtctggaagctgtggaagcggtgtttggttttgatgaacgcaataaaatcgtcaggaaattgtgtcagcgaattgccgagaaatatgcgcaatgctgcgatatcgtgacatttaatgccgatctctatttactcctgtgccgggaaaatgtacagacgtttacccgtaagatagcgacggtaaacgattttgacagcagttttggctaccgcaatctgcgcatccataagtctgctatttgtgaacctttgcagggggaaaacgcctggagttacgcagaaaagctgaaactggcgatttccagtatccgcaaccatatgttctcagagtttattttctgtgatgatgcgaaactcaacgaaatagaagagaatatctggattgcgcgtaatattcgccatgcaatggaaattggcgaactattcctggtctatcaaccgattgttgatattaacacccgcaccattttgggcgcggaggcgttgtgccgttgggtgtctgcggagcgggggattatttcaccgctgaagttcattaccattgctgaagatatcgggtttatcaatgagctgggctatcaaattattaaaaccgcgatgggtgaattcagacattttagcgagcgtgcggtcctgaaggacggtttcttactgcatattaatgtttcgccctggcagttaaacgaaccacactttcatgagcgttttactaccatcatgaaagaaaatggcctgaaggcgaacagcctttgtgttgagatcactgaaaccgtgatcgagcgaattaatgaacatttctatctcaatattgaacaactgcgtaaacaaggggtacgggtatcgattgatgactttggcaccggtttgtcaaacctgaaacgtttttatgaaatgaatccagacagtataaaggtggattcgcaatttaccggcgatattttcggtactgcaggaaaaattgtgcgcattattttcgatctggcacgctataaccggatcccggtgattgcggaaggcgtagagagcgaagacgttgcgcgtgaattaatcaaattaggatgtgttcaggctcaggggtatctgtaccagaaacccatgccattctccgcctgggataaaagtggaaaattagtaaaagagtagtttacgtatgtccagaatcaataaattcgtacttacagtcagtctgctgatttttatcatgatttcagcagttgcctgcgggatctacactcaaatggtaaaggaacgggtgtatggcctgaaacagtccgttattgatactgcttttgcggtggcaaatattgctgaatatcggcgtagtgtggcaattgatctgatcaacacgctaaatcctacggaggaacagctgttggttggcttacgcacagcttacgccgactcggtttcaccctcttatttgtacgatgtcggtccttatctgatttccagtgacgaatgtattcaggtaaaggagttcgagaaaaattattgtgcagatattatgcaggttgttaagtatcgacatgtcaaaaatacagggtttatctcttttgatggtaaaaccttcgtctattacctctatccggtaactcacaatcgtagtctgatatttttgcttggtctggaacgtttttctttactgtcaaaatcgctggcgatggatagcgagaacctgatgttctccctgttcaagaacggtaaatcggtgaccggtgatgaatataacgctaaaaacgccatcttcaccgtttcggaagcaatggagcacttctcctatttgccgaccgggttgtacgtatttgcttataaaaaagacgtttattttcaggtatgtacattgattattttctttgccgcattggtggcagtgatatcgggtgccagttgcctctatctggtacgcagagtgattaatcgtggtattgtggagaaagaagccattattaataaccattttgaacgcgtactggatggcgggcttttcttttcggctgccgatgtcaaaaaactctacagtatgtataactcggcattcctggacgatctgaccaaagcgatgggcagaaaatcttttgacgaagatttaaaagcgctgccggaaaaaggcggttatttgtgcctgtttgacgtcgataaattcaaaaacattaacgacaccttcggtcatttgctgggcgatgaagtgttgatgaaagtggtgaaaatccttaaatcacagatcccggtagataaaggtaaagtctaccgcttcggaggtgacgaatttgcggtgatttatactggcggcacgctggaagagttgctatcgattctaaaagaaatcgttcatttccaggtgggaagcattaatttaagtaccagtatcggtgtagcgcattcaaatgaatgtactaccgtcgaacgcttgaaaatgctggcggatgagcggctgtataagagtaagaaaaacggcagggcgcagattagctggcagtaatcattattcgcaggccggacaaatgattttgcccggcctgaattaattaaacccggctaccccacaaatcgtactcatcggcgtgctcgactttcactcgcaggatatcacccggcttaacgttggtttcaccattgagataaaccgcgccgtcgatttccggtgcatctgccatgctgcgaccaatcgcgccttcttcgtccacttcgtcgataatcaccagaatttcacggcccactttctcttgcaggcgctcggcggaaatttgctgctgcaactgcatgaaacggttccagcgttcttctttcacttcttccggaacctggtcaggcagggcattggcgtctgcaccttcaaccgggctgtatttaaagcagccaacgcgatccagacgtgcttctttcaggaagtcgagtagcatctggaaatcttcttccgtctcgccagggaagccaacaataaaggttgagcgtagggtcagttccgggcagattttgcgccactgtttgatgcgcgccagttggcgatctacagaacccggacgtttcatcagtttgagaatgcgcgggctggcgtgctgcaacggaatgtccagatacggcaggattttgccctctgccatcagtgggatgacgtcgtccacatgcggataagggtaaacgtagtgcagacgtgtccagatccccagtttcgataactgttcgcacaggctgaccatgctggtttttaccggctcgccgttgtggaagccagtacgatgtttaacatcgacgccatacgcggaagtatcctgcgagatcaccagaatttctttaacgcccgcatcaaccagacgtttcgcttcacttaacacttcgccaatcggacggctcaccagatcgccgcgcatagacggaataatgcagaaggtgcagcggtgattacagccttcagaaattttcagataggcataatgacgcggcgtcagtttcacaccttgttctggcaccaggctcaggaatgggttgtgtttcggttttggcacgtagtgatgaacgtgctccagaacctgctcatagctatgaggcccggtgatttccagcactttcgggtggacttcgcggatctgatcttcttttgcccccagacaaccggtcacaattaccttgccgttttcattcaacgcttcaccaatggcttccagtgattcttgtaccgcgctgtcaataaagccgcaggtgttgacgatcaccatgtccgcatcatcatagctcggtaccacgtcataaccttcagtgcgtagttcggtgagaatacgctctgaatcgacaaggtttttcggacagccaagggaaacaaagccgattttcggctggggagttactttgctcatagcttaaaaaatattcagttacaggaaaggtcagggcagggattctacagagttctggataaaatttgtatcgcaatctcattcgctggcggagttgaaggaaatgtaaattttgttaattcggcgtgaagaattgatcctggacagcattttgctcaaaaaacagccatactatttagttgcaacaaggctggaaagaggaggatcgaagtatgttcgttgacagacagcgaatcgatctgctgaacaggttgatcgacgcacgcgttgacctcgccgcatacgtgcaactgaggaaggcaaaaggatacatgtccgtcagcgaaagcaatcatctacgagataacttttttaaactgaatcgcgaactgcacgacaaatcgctgcggttgaatcttcatctggatcaggaagagtggagtgctcttcatcatgctgaagaagcattagcgacagccgcagtatgtttgatgagtgggcaccatgattgcccgactgttattaccgtcaacgccgataagcttgaaaattgtctgatgagcttaacgctgagtatccagagcctgcagaagcacgccatgcttgagaaggcctgaaaactaagggggagaaagcgtctcccccttcatgtttaagtttttgtaaaaatgaatttgttatctcctccactgactacgctttaagccagagtcaatccggaggcgttatgcatcgacaatcctttttccttgtgccccttatttgtctttcttccgctctctgggcagctcctgcaacggtaaatgtcgaagtactgcaagacaaactcgaccatccctgggcgctggcctttttacccgataatcacggtatgttaatcactctgcgcggcggcgagttgcgtcactggcaagcaggaaaaggattatctgcgccgctttccggagtgccggacgtttgggcgcacgggcagggcggcctgctggacgtggttttagcgcccgattttgctcagtcgcgccgcatctggttaagttattccgaagttggcgatgatggcaaagccggaactgctgtgggttatggccgcttaagtgatgatctctcaaaagtgaccgacttccgcaccgtctttcgtcagatgccaaaactgtctaccggtaaccattttggcgggcggatggtattcgacggtaaaggttatctttttattgctctgggcgaaaacaatcagcgcccgacggcgcaggatctggataaattacagggcaaactggtgcgtctgaccgacctgggagaaatcccggatgataatccttttataaaggaatccggtgtgcgcgccgagatctggtcttatggcattcgtaatccgcaaggaatggcgatgaatccgtggagtaatgcactatggctgaatgaacatggcccgcgcggtggtgatgaaattaatattccgcaaaaaggcaaaaactacggctggccgctggcaacctggggaatcaactattcgggctttaagataccggaagcgaaaggggagatcgtcgccgggaccgagcaacctgttttttactggaaagattcgcccgccgtgagcggcatggccttctataacagcgacaaattcccccagtggcagcaaaaattatttattggcgcgctgaaagataaagatgtcattgtgatgagcgtcaacggcgacaaagtgacagaagatggccgtattttaacggacagagggcagcgaattcgtgatgttcgcactggacccgacggttatttatacgttctcaccgacgagtccagtggggaattacttaaagttagcccacgcaattagctaacgggaatcatcaccactttgcgcactgcggggcgttcagtgagttgctgataccagcgttgcagatttggacgcggtgtccaggtcaggccaacgttaaacaaattgtagatgaacggtgcgatagcgatatcgcccacaccaaactcgtcgcctgagaaccattttacttttgccagttccgcatcgagcagggcaaacagggcgtcgcactctttgcaactggcatcaatggcggcctgatcgcgctcttccggtggtgttctgactaatcccatcaggatcccgcgatgagcattactgagcgtctggtttgcccagtccatccatttttcggcttccgcacgacgtgccggtgagtcgatccacaggcgtttttgcccgtactgtgccgccagatagcggacaatggcgtttgattcccaaagaatgagatcactttcgtcgtcacgcaacaacggcaccagcccgttagggttcatcgccagaaaatcagcatcgtgatttatcccaaactcacggcccgcgagaatttgctcataaggtagttccagttcttcgagcgtcagcaatactttttttacgttggttgaattattccgaccccacagcgtaatcatactcaccccttttccgacaggcagccacaggctgaacaggactccgatggtgaagtaaagttaacttttaagcaacagctggcaaaaaaatgacaccagaagcagcgaagcggcaggatattgcataaactttaaaaactttaccaacttacggtttctttaagtttgtgtgtgcgttattaatcaccgaacttatcatacggcgatataacgtattttttttgaatggatactcgggtggcatttatgacgcaatactcctctctccttcgtggtcttgcagcgggttctgcatttttattcctttttgccccaacggcattcgcggcggaacaaaccgttgaagcgccgagcgtggatgcgcgtgcatggattttaatggattacgccagcggtaaagtgctggcagaaggcaatgcggatgagaaactggatcccgcgagcctgactaaaattatgaccagctatgtggttgggcaggcgcttaaggccgataagattaaactcaccgatatggtgacggtcggtaaagatgcctgggcgacgggaaatccggcactgcgtggttcatcggtaatgttcctcaaaccgggcgatcaggtttcggtggcagacttgaacaaaggtgtgattatccagtccggtaatgacgcctgtattgcgctggctgattacgttgccgggagccaggagtcatttattggtttgatgaatggttatgccaaaaaactgggtctgaccaacactaccttccagacggtgcacggcctggatgcgccggggcagttcagtaccgcgcgcgatatggcattgctgggtaaagcattgatccacgatgtgccggaagagtacgccattcataaagagaaagagttcaccttcaacaaaattcgtcagcctaaccgtaatcgtctgctgtggagcagcaatctgaatgttgatggcatgaagacaggaaccacggcaggcgcgggatataatctggttgcttcggctacccagggcgatatgcgtttaatctccgtagtgctgggggcgaaaactgaccgtatccgttttaatgagtctgagaaattattgacctggggcttccgtttctttgaaaccgtgacgccaattaaacctgatgccacatttgtgactcagcgcgtctggtttggtgataagagcgaagtgaatctcggggcaggcgaagcgggctcagtgaccataccgcgtgggcagctgaaaaacctgaaggcgagttatacgttaacggaaccgcagcttaccgcaccgctgaaaaaaggtcaggttgtcggcaccattgatttccagcttaacggtaaatccattgagcagcgtccgctgatcgtgatggaaaatgtggaagagggcggattctttggtcggatgtgggatttcgtgatgatgaaattccatcagtggttcggcagctggttctcttaatcttctgataaccggatggcgcgaaacgtcatccggttatacgtcattaatacatcaacttaatacgctgcgtctgcgcgtacttcacatactcatcttccgggcaacaatcgctcacaacaatatcaaagcgtttcaggtcacccatgcgcgccggacgcaccttgccaaatttactgtggtcgacaaccagcacatgcttttgcgccatcgacatggcccagtgttttaccggcaactcttcaagattaaagcaggtagcgcctttactgacatgcacgcccgcagcggaataaaaagcgatatccgggcaaaaattattcagcgtttgctgaaaatcgatgggtttgaaaatggcgttgctggcgtgaaattcaccaccgcaaagaaacgcgcggcaatggggtttctctttcagcgccagaaaggtatttagcgaataacaaacggcggtaaaagggatttcattatcaattgcttcaataatccacggcgtggtggtgccacagtcaaaaaagagggtctgatcgggttctaccagcgtcgcagccagttttgccgcccggcgtttttcttccaccaggcgggatttttgatcgcttaacaggtaatggctggcgctgcgtggttccagaacaatatagccgccgagcaaaacgacgggcgcactgtggttgttcagatcgcgacgaatcgtcatctccgaaaccccaagcagggcggcggcgtctttaagatgtaacttatcactgcgttttaattcttgcagcagctgcccgatacgctcttcgcgacgtgtttccataatccctctgaatagttattgaagcgagccgctcaatactacactttttagcagagatcagtcacgcacccagcctttgcggatcggtaatgcaaaacagaagcgataccacgattgcagacgttgatagagtttatgccccatcgcttgccagataatctgggcgctaaggcagccaatcatacctgccagcaatccaccgagcatatccagcggccagtggacgccaagataaacgcgcgaccaggcaatgacgacggccagcaccattaaaagtgagccggaccacaggcgatgccagcataaaaatgccagtgcaaaggtgaaaatcaccgtaccgtgatcgctcgggaatgagtcatccgccgcatgatgcaggaagttatagccgatattttcgacaaagggtcggtcgtgcggaaaaagatgtcccatcgtccaggacacaaacaggctgaccgccagcgcgatagcgatttttatcaccagttgccgttgtgctgtgagcccccacaaccaaagtactgcggccagcaacggcaccacggtaatcaaatctttagcaataaaaatcgccaacgagatcatccacggcgcagagtctggcgttgcgttaataagagagaatagagagagattcaaattttccagcataacttcccgacgcaaagtgattaaaagggagccaatacaggcaagtcgttgagaataaagtgcaggttaaactgggtaaagcggcatcgtcttatttccctcaagcggcctgtttacggtaggtgattgtaacgggcaaaggttaaataaaacttaaagaaagcgtagctatactcgcaataatgtaagaatgtgcttaaccgtggtttcagctacaaaattcgctttctcgttagctgcgcttttattaaactttgcgcgattattattggcgaagaaattgcatgcaaaataaattagcttccggtgccaggcttggacgtcaggcgttacttttccctctctgtctggtgctttacgaattttcaacctatatcggcaacgatatgattcaacccggtatgttggccgtggtggaacaatatcaggcgggcattgattgggttcctacttcgatgactgcgtatctggcgggcgggatgtttttacaatggctcctggggccgttgtcggatcgtattggccgccgtccggtgatgttggcgggagtggtgtggtttatcgtcacctgtctggcaatattactggcgcaaaacattgaacaattcaccctgttgcgcttcttgcagggcataagcctctgtttcattggcgctgtgggatacgccgcaattcaggaatccttcgaagaggccgtttgtatcaagatcaccgcgctaatggcgaacgtggcgctgattgctccactacttggtccgctggtgggcgcggcgtggatccatgtgctgccctgggaagggatgtttgtcttgtttgccgcattggcagcgatctcctttttcggtctgcaacgagctatgcctgaaaccgccacgcgtataggcgagaaactgtcgctgaaagaactcggtcgtgactataagctggtgctgaagaacggccgctttgtggcgggggcgctggcgctgggattcgttagcctgccgttgttggcgtggatcgcccagtcgccgattatcattattaccggtgagcagttgagcagctatgaatatggcttgctgcaagtgcctattttcggggcgttaattgcgggtaacttgctgttagcgcgtctgacctcgcgccgcaccgtacgttcgctgattattatgggtggctggccgattatgattggtctgttggtcgctgctgcggcaacggttatctcatcgcacgcgtatttatggatgaccgccgggttaagtatttatgctttcggtattggtctggcgaatgcgggactggtgcgattaaccctgtttgccagcgatatgagtaaaggtacggtttctgcggcgatggggatgctgcaaatgctgatctttaccgtcggtattgaaatcagcaaacatgcctggctgaacgggggcaacggactgtttaatctcttcaaccttgtcaacggcattttgtggctgtcgctgatggttatctttttaaaagataaacagatgggaaattctcacgaagggtaaaaaaatgcctgattgctttgtgcgatcaggcattctcgaattaatggtgatggtcgtcaatctggtgttcgataaccatcccttcacctacgctggcaagatggcgaacataaggatgcgggcggtaagccggagctggcgcaggagccacatagacggtttgcggcacagtcgcgacgctgaccgcttgtggaacgctgactgaatcaggaaccacaaccactttgtatccactcggcacatcgacggtgacactttgcgccatcgccacaccagtaaagcccattaaaagcgcgcccaacagtagacaatttttcataatcatttcgcctgaaataatgcagcgggttaatttccgcgaattatgcagccttcattcaggcattgtgttgccgggcgtgctgccttttttattgcttaaatggcgcttcgtgtttaagcactttatcgatcacatccagtacgccttcacggttattggagcctgcccggtattttgccgctgcgacgaccgcgctgccggcattttccattgcaaaactaaagcctgcctgacgcagcatctcaatatcgttaccgccatcgccaaagaccaccacttcgctgtcgtctattccccataatttctgcagttggcgaaggccattggctttatgtacgccggggataatcagatcgatgctgccgttgccggtgtggaccggcaccataatatcgccgatggcctcatgtaatgctttttgtacttgtggaatcagttcatcggaaagattcagaccaaacttaaagaagatatcttctaagttgtcaaagttatcgacgtattccagacggtgataatacatttccgccaccgttttcatggcatcgtcatattttttgagggtataggcgctattttttccgcaggcaataatttccacttccgggcgcgtcagcaaatgttccacgacagtagcaaacgcatccttcgacagctcgccattaaaaacatctttgccttcgctcactacccagccgccgttttcagccacaaaggctatttcattagcaatttcagggaagaaagagatcaactgataatattgattcccgctggcgaccacaaagcgaatgccttgtgctttcatttgctgatactgagccataaaccgctcacggttataggttttttgatcgcttaagaaagtaccccgcaattaatttaatgctcatcaactattctccatcgccgtctgcgttttggtatcgggtttggcgacggctttcgcgacaatagccgcgagaataaccagcgccagtacaaccagcattgcactacgtaatccataatgttcgccgagatagcccagcagcggcggcccgacgaggaaagccagataaccggtcgtagctaccacgctgacgcgggttggtgcatcggggccggtatcgctggcggcagaaatagtcagcgggaagcccaacgaggcacccagtccccaaagtacaacagacaccccagcgacccaggcgctatcgacaaaaataatcagcccaatacccaacgcccccattagtgcactggcccgaaccacggcaacgcgactgtaacggtcaatgaaccaaccgccggtaaagcgtccaacggtcatccccagggtaaacccggcataaatcagcgagccggaagtagggctaaaaccgtgaccatcaaccattaataagggtaaccagtcgttggcagaaccttcggcaaaggccatcgccagcaccacaacaccaatcagcagcaactggatatcgcgataaaaaggtacgcctttttcaccatgctgggtgccatcggcagcatttttgcccgtaccgtcagggattgcctgaatggcgatataaataggcgcgatgcctaccagcgccgccaataaaatgtgcaccgttgccggaacgccaaaggccgtcagtgccatcccgacacctgcgcctgccagcgtgcccaggctataaaaaccgtgcatcatcggtaaaaccgtcttattcatttctctctcaacggcggcaccttcaacgtttatcgccacttccgcagaaccaaaactagccccaaagacgccgagaccaacggcaaagagcaagggcgatgtcagccagagtgccagacttagtatcatcatcccaatcaatgcgcaggacatcgtgacaaggatgacattacgcgtcccaaagcgtttcactaaccacgctgagcagagaataccgctcatcgaaccgatcgacagaccaaagagaacaccgcccatttcagcgatcgagacagagagaatatcgcggatagcaggcgtacgggttgcccaggacgccattaacaggcctggcaaaaagaagaacataaacagcgcccaggttcggcgtttcaatgcattacgtgaagaatttacggtcatagaccacgtcaaaataagaagagggaagacaacattagcaagactgtgtacatttgtacacaattgcagagagaggaaatgacatgcgtcgcgctaacgatccgcaacggcgagaaaaaattatccaggccacgctggaggcggtgaaactttacggaatacatgctgttacacaccgcaaaattgctgcccttgccggggtgccgttgggatcgatgacctactatttttcaggaattgatgagttgttgctggaggcgttcagccgttttactgagatcatgtcccggcaatatcaggcattttttagcgatgttagtgatgctccaggcgcatgccaggctatcaccgatatgatctacagctcacaggtcgcaacgccggataatatggagctgatgtaccagctctacgcgctggctagccgaaaaccgctcttaaaaacggtaatgcaaaactggatgcagcgcagtcaacaaacgctcgaacaatggtttgaacccggaaccgcccgcgcgcttgatgcgtttattgaggggatgacgctgcattttgtcaccgaccgtaagccgctatcacgcgaggagattttgaggatggttgagaggattgctgggtagtagataaatttcaggcaacaaaaaacccatcaaccttgaaccgaaatggcggggttgatgggctccacaaaatggggacatcaaagaaaagcagtggcactaattaagactgatgccctgcggaaaagttctgcggttgtgcaaaaaaatttcattttcagggcaacttcagttttatcctaatcctggccataccatgacgatgattgtccctgccagcgtcagcaggacgttggcgattgcataggtgcccgcatagcccagcgccgggatgttactgcgagctgtatcactgatgatctccattgccggcgcgcaggtgcgtgcgcccatcattgcgccgaacaacagtgcgcggttcattcgcaatacataagcaccgaacaagaaacagataaccactggcacaagactgacaatcaatccggcaatcaacatctgaccgccaatcgcgcccaggccgttattaataccgctaccggcgctcagaccaacgcctgccataaacaccattaagccgaactctttcaccatgcttaatgcaccctgcggaatgtaaccgaaggtcgggtggttagcgcgcataaatcccagcataattccggcgaataacaacccggcagcgttccccatgccgaaactgaatgtgctgaactggaaggtgatcatcccgatcatcagcccaataacaaagaaggcgcagaatgccagcaagtcagtgacctggctgtgaatcgagataaagccgatgcgatcggcgatggtttttacgcgacgggcatcgccgctgacttgtaaaacgtcacctttgttaagcacgacgttgtcatctatcggcatctcaatctggctacgaatgacgcggttaaggaagcaaccgtgatcggtcaacttcagttgtgcgagacgtttgcccacggcgttatggtttttaacgaccacttcttcagtgacgatacgcatgtcgagaaggtcacgatcgaaaacttctttgccgttacggaagctgggatcgagtcgtgcgtgggcgtcgggatagcctaccaacgctatttcatctcccatttgtagcacagcatcaccgtctggattcgccagaatcccgttacgtcgaatacgttcaatgtagcagccagtttgtcgataaatacccagttcacgcagatttttgccgtcggtccaggccaccagctccgggccgacgcggtaggcgcggatcaccggtaaataaaccttacggttggcatcagtgtccaggccacgttcgcgggcgatttgctgggcgctggtctgtaagtcctgatgctgcaatttcggcaagtaacgcgcaccaacaatcaaactcaccagaccgattaaataggttaaggcatacccgaggctcagattatccagtgccagtgagagctgcctgctttccatgccggaatgacgcagtgtatcgccagcaccgaccagaaccggtgtcgacgtcatagagccagctaacataccggccgtcaggccaatatcccagccaaacagcttacctaaccctaaggcgatcaccagcgcactgccaaccatcaccagtgctaacattaggtaatttttcccatcgcgaaaaaaaatggaaaaaaagttcggtccggcttcgaccccgacgcagaaaataaacagcataaagccaagattaagcgcgtcggtgttaatgctgaaatgttgttggcctaataacagcgatacgactaaaacgccaatggaattacccagttggatcgaaccaagtcgtaatttcccgagacatagcccaagcgcgaggaccacaaataataacagaatgtaattcccatttaacaattcggcgacgtttatattcacggaggctaacttcttgtttactagtaagctgttgaaagaaatggtaatttacgataatgttttttaccagaattcagggcgcagattcattcagcgcacctaaacgatagtaaagtaacaatatattttactagtgtaatcacattaggtatcaacggctatatgaattgcgttggcctatattagcatggaatgcgaagcggctttatcttactgaacgccacactggcgaaaaatgtgttcgatagacgcagtgtcaggaggaacgagtgaaacataaacaacgttgggcgggggcaatctgctgttttgtcctcttcattgtggtgtgtctttttctggcgacgcacatgaaaggcgcttttcgggctgccgggcatcctgaaatcggtttgctatttttcattcttcctggtgcagttgccagcttcttttcacatcgtagagaagtcctgaaacctctgtttggcgcaatgctggcggcaccctgttcgatgctcattatgcggctgtttttttcaccgacgcgctcattctggcaagagctggcatggttattaagtgcggtgttctggtgtgcgctgggggcattgtgtttcttatttatcagtagtttgtttaaaccacagcacagaaaaaatcaataaagccctcaacgcgagggcttgtcagacgatcaggcgtccagattctctttcacccatgcagcaaaatcggtatagccgccgatatgttgctgatcgacaaaaatctgcggcacggtttctacgggtttacctgccttttgttgtagatcttctttagtgatcccttccgcacgaatatctacatactgatactggaaatcatcgcgctcattgctcaatttctcggccagatcttttgcacgcacacagtaagggcaacccggacgaccaaaaataacggtttgcattatttctctcctcatagatttatgcctgtaatgatcacgctaaaatgtattcgctgaaagtaggtttaacctgttgcattaattgctaaaagctataactgttaaacacaatgcagtgaaaagttttagactgaaggctcactttgcagagggaagcgtatgcgcgcgatcggtaaattgcctaaaagcgtgttgatactggaatttatcggaatgatgttgctggcggtggcgctgctgtcggtaagcgactccctgtcgctacctgagccattttctcggccagaagtgcagattctgatgatttttctcggtgttttgctcatgattcccgctgcggtggtggttattcttcaggtggcaaaacgtcttgccccacagctgatgaaccatccaccgcaatattcacgttcagaaagagaaaaagataatgacgccaaccattgaacttatttgtggccatcgctccattcgccatttcactgatgaacccatttccgaagcgcagcgtgaggcgattattaacagcgcccgtgcgacgtccagttccagttttttgcagtgcagtagcattattcgcattaccgacaaagcgttacgtgaagaactggtaacgctgaccggcgggcaaaaacacgtagcgcaagcggcggagttttgggtgttctgtgccgactttaaccgccatttacagatctgtccggatgctcagctcggcctggcggaacaactgttgctcggtgtcgttgatacggcaatgatggcgcagaatgcattaaccgcagcggaatcgctgggattgggcggggtatatatcggcggcctgcgcaataatattgaagcggtgacggaactgctgaaattaccgcagcatgttctgccgctgtttgggctgtgccttggctggcctgcggataatccggatcttaagccgcgtttaccggcctccattttggtgcatgaaaacagctatcaaccgctggataaagacgtactggcgcagtatgacgagcaactggcggaatattacctcacccgtggcagcaataatcgccgggatacctggagcgatcatatccgccgaacaatcattaaagaaagccgcccatttattctggattatttgcacaaacagggttgggcgacgcgctaaaactgccacgtcgatgtatgatacgcgggcttttgaccaggtctgacagagaggtgcagggtgaaaattgccatattgtcccgggatggaacgctctattcgtgtaagcggctgcgtgaagccgctatacagcgcggtcacctggttgaaattcttgatccgctttcttgctacatgaacataaatcctgcggcgtcttctattcactacaaaggccgcaagttaccccattttgacgcagtgatcccgcgtattggcaccgccattaccttttatgggacggcggcactgcgccagttcgagatgctggggagctatccgctcaatgagtcggtcgccattgcccgggcgcgtgacaaattgcgttccatgcaactgctggcgcgtcagggcatcgacctgcctgtcacgggcattgcgcattcgccggatgataccagcgatttaatcgacatggtcggtggtgcgccgctggtggtcaagctggttgaaggcacgcagggaattggcgtcgtgctggcggagacgcgtcaggcggcggaaagcgtgattgacgctttccgcggtctgaacgcgcatattctggtgcaggaatatatcaaagaggcgcaagggtgcgatatccgctgtctggttgttggcgatgaagtagtcgctgcgattgaacggcgggcgaaagagggcgattttcgttccaatttgcatcgtggcggcgcggcaagcgtcgccagtatcacaccacaggagcgtgaaatcgcgataaaagccgcgcgaacgatggcgctggacgttgctggtgtggatattctgcgtgctaatcgcgggccgttggtgatggaagtgaatgcgtcgccagggctggaaggaatagaaaaaaccaccggtatcgacatcgcgagtaaaatgatccgctggatcgaacgccacgctacgacagaatattgcctgaaaacgggtggttagtcgcaatcacattactgatcatggttttgcctgcgctttttgcgtaagctgtgccggtctttttatcggaagaggttgtacaaaattatgacatcgctggtcgttcctggtctggatacgttgcgtcaatggctcgatgacctggggatgagtttttttgaatgtgataactgtcaggctctgcatctgccccatatgcagaatttcgacggtgtctttgatgctaaaatcgatctgatctataacacgatcctgttttctgccatggcggaagtccgaccttcagccgtattgccgctggcggcggatttatcagccatcaatgccagttcgctgaccgtgaaagcatttcttgatatgcaggatgataatctgccaaagctggtggtttgccagtctttatccgttatgcagggcgtaacctatgagcagtttgcatggttcgtgcgtcagagcgaagagcagatttcgatggtcattcttgaagctaatgcccatcaactgctgttaccgactgacgatgaagggcaaaataacgttaccgaaaactatttcctccactgataactcctttcgagcacgcagtcgctgccgcagtgactgcgtgccgcaaaattatccgctgtttttaaccttttattaaagattaattcacttctcttgtgccgatttggctttatcacatagagcaaatacgcataaaatttgttaaataccgttttttaatccgagctatagtctcaaaccctggctaaagttattcttgcgatgcttttatatagtgagcagtgcaggccgggagagagttctcttttcttacaccgcgccgataaaaatatgcacgtttattgcatatctttcagtgtgacaacttttgttcgtttgttaacgaattttcagaaggaaagagatatgaccgccttaaataaaaaatggctatcgggtctggttgcgggggctctgatggctgtctctgtcagcacgctcgcggctgaacaaaaaacactccacatttataactggtctgattatatcgccccggacaccgtggccaactttgaaaaagaaaccggtattaaagtcgtctacgatgttttcgattctaacgaagtactggaaggcaaattaatggcggggagcaccggctttgatctggtggtgccgtcagcaagctttcttgagcgccagctgacagcgggagttttccagccgctggataaaagcaaattgccggagtggaagaatctcgatccggagctgctgaagttggtcgccaaacacgatcccgacaataaatttgctatgccctatatgtgggcgacgaccgggattggctataacgtcgataaagttaaagcggtgctgggcgaaaacgcgcccgtcgatagctgggacttgatcctcaaacctgaaaatctggaaaaactgaaaagctgcggtgtctctttcctcgatgcgccagaagaagtgtttgctaccgtgctgaattatctcggcaaagatcctaacagcactaaagcggatgattacaccggaccggctaccgatctgctgttaaagctgcgcccgaacattcgttatttccattcatcccaatacatcaatgatctggcgaatggtgacatctgtgtcgctattggctgggcgggcgatgtctggcaggcgtcaaaccgcgcgaaggaagcgaagaatggcgtgaatgtctcgttctcgattccaaaagaaggggcgatggcgttctttgatgtattcgccatgcctgcggatgccaaaaacaaagacgaagcctatcagttcctgaattacctgctgcgtcctgatgtggtggcacatatctctgaccatgtgttctatgctaacgccaataaagcagccacgccgctggtgagtgcggaagtccgtgataacccgggtatttatccgcctgcggatgttcgtgcgaagctgttcactctgaaagtgcaggacccgaaaatcgaccgtgtgcgcacccgcgcgtggaccaaagtgaagagcggaaaataatccgcagccgtagatgccggacgggcgcaccacacccgccggcaattcgcaccatcatggtgcgcttgcacacattcaatgccggagagcagccgtgaatgacgctatccctcgcccgcaggcgaaaacccgtaaggcgctgacgccgctattagaaatccgtaacctgaccaaatcctacgatggtcaacatgcggtggatgatgtcagcctgaccatctacaaaggtgaaatcttcgcgctgctgggcgcatccggctgtggcaagtccacgctgctgcgtatgctggcaggttttgaacaaccttcggccgggcagattatgctcgatggcgtcgatttgtcacaggtgccgccttacctgcgccccatcaatatgatgtttcagtcttacgcgctgtttccgcatatgaccgtggaacagaacatcgcttttggcctgaaacaggacaaactaccgaaagcggaaattgccagccgggtcaatgagatgcttgggctggtgcatatgcaggagttcgccaaacgcaaaccgcatcagctttccggtggtcagcgtcagcgtgtggccctggccagaagccttgctaagcgcccgaaactattactgctcgatgagccgatgggcgcgctggataaaaagctgcgtgaccggatgcagcttgaagtggtggatattctggagcgcgtcggtgtgacctgcgtaatggttactcacgatcaggaagaggcgatgaccatggcggggcgtatcgccattatgaatcgtgggaaatttgtccagattggcgagccggaagagatctacgagcatccgaccactcgctacagcgctgaatttatcggttcggttaatgtctttgaaggtgtactcaaagagcgtcaggaagatggtctggtactttattcgccgggactggtgcatccactgaaagtcgatgtggatgcttcggttgtcgataacgtgccggtgcatgtggcgcttcgcccggaaaaaatcatgctttgcgaggaaccgcccgccaatggttgtaacttcgcggtgggggaggtgatacacattgcctatctcggcgatctttcggtgtatcacgttcgtctgaaaagtgggcagatgattagcgcccagctacaaaacgcccatcgtcatcgtaaagggttaccgacctggggcgacgaagtgcgtttgtgctgggaagtggacagctgtgtggtgctgacggtttaaggagcaaatatgagtacacttgaacctgctgcccagccaaaaccctttaagctgtggttgtcgcagctgcaaatgaaacatgggcgcaaactggttattgcgttgccatatatctggttgatcttgctgtttctgctgccatttctgatcgtctttaaaataagcctggcggagatggcgcgcgctattccaccttataccgaattgatggagtgggctgacgggcaactttctatcactcttaatctcggtaattttctgcaactgaccgacgatccgctctattttgatgcttatctccagtcgttacaggtggcggcgatttcgactatttgctgtttactgatcggctatccgctggcgtgggcggtggcgcacagtaagccttcgacccgtaatatcttattactactggtgatcctgccgtcgtggacctcgtttctgattcgtgtctacgcctggatgggaatattaaaaaacaacggtgtgctgaataattttctgctgtggctgggggttatcgatcaaccgctgaccattctgcataccaactttgcggtttatattggcattgtttacgcctacgtgccgtttatggtgctgccgatttacaccgcgttgattcgtattgattattcgctggtggaagcggcactggatctcggtgcacgaccgctgaaaacgttctttactgtgatcgtgcgctgactaaaggtgggattattgccggatcgatgctggtgtttatcccggctgtgggcgagtttgtgatcccggaactgctcggtggcccggacagcatcatgatcgggcgcgtgctgtggcaggagttctttaacaaccgcgactggccggtggcctcagcggtagcgatcatcatgttgctgctgctaattatgccgataatgtggttccacaaacatcagcaaaaaagcgtgggagaacacggatgaataatttaccggtggttcgttcgccctggcggattgtgattttgctgttgggcttcacctttctctacgcgccaatgctgatgcttgttatctattcgtttaacagctcgaagctagtgacggtgtgggccggctggtcaacgcgctggtatggcgaattattgcgcgatgacgcgatgatgagtgcggttggtttaagtctgacaattgcggcctgtgcggcgacggcggcggcgatcctcgggactattgcggcggtcgtgctggtgcgctttggcaggtttcgcggatcaaatggttttgccttcatgatcaccgcaccgctggtaatgccagatgtcatcacgggtttgtcgctgttgttgttattcgtcgcgcttgctcatgctattggctggcctgcggaccgcggtatgctcaccatctggctggcgcatgtcactttctgtacggcttatgtggcagtcgttatttcgtcgcgtctgcgggaactggatcgctcgatagaagaagccgcgatggatctcggtgcgacgccgctgaaagtgttttttgtcattacgctaccgatgatcatgcccgcgatcatttctggctggttactggcttttactttgtcgcttgatgatctggtgatcgccagctttgtttccgggccgggagccaccactttaccgatgctggtcttttccagcgtgcggatgggggtgaatccggaaatcaacgccctggcaacattgatcctcggcgcggtcggaattgtcggatttatcgcctggtatctgatggcgcgcgcagaaaaacagcggatacgcgacatccagcgtgcaagacgtggctgaagacactaaaatttgccaacctggctacataatgccgcgcatgtcgcggcattgttttcatggaagacgaaacgttgggattttttaagaaaacatcttcatctcatgctcgcctgaatgtgcctgcgctggtgcaggtggcggcgctcgccattattatgatccgtggcctcgacgtgctgatgattttcaatacgctgggcgtgcgcggtattggcgagttcattcatcgcagcgtacaaacctggagtttaacgctggtctttttaagcagtctggtgctggtttttattgagatctggtgtgcgttttcactggtgaaagggcgtcgctgggcgcgctggctgtatctgttgacacaaatcacagccgcaagttacttgtgggcggcctcgctggggtatggttatccggagctgttcagcattcccggtgaatcaaaacgtgaaatcttccatagcctgatgctgcagaagctgccggatatgctcatcctgatgctgctgttcgttccctcgaccagtcggcggttcttccagttgcaataatgtgtataatcgtcgcccctgatgatgtgaaggtcaatgtatgcagtgcgcactttacgacgcgggtcgctgtcgttcctgtcagtggataacgcagccgattccagagcaactctccgctaaagccgccgatcttaaaaatctgctcgccgattttccggttgaggaatggtgtgcgccggtgtcaggcccggaacaagggtttcgtaataaagccaaaatggtggtgagtggtagcgttgaaaaaccactgctcggtatgctgcatcgagatggtacaccggaagacctttgtgactgcccgctttatccagcctcatttgcgcccgtttttgcggcgctaaaaccgtttatcgcccgtgcggggttaacgccctacaacgtggcgcgtaaacgtggtgaactgaaatacattctgctgactgaaagccagagcgatggcggcatgatgctgcgttttgtactgcgttctgataccaaactggcgcaactgcgtaaggcgctgccgtggttacaggaacaattaccgcagctgaaagttattaccgtcaatattcagccggtacatatggcgattatggaaggggagacggagatctacctgaccgaacaacaggcactggcagagcgttttaatgacgtaccgctgtggatccgtccgcaaagtttcttccagactaatccggcggtcgccagccagctgtacgccaccgcgcgcgactgggtacgacagctgccggttaaacatatgtgggatctgttctgtggtgtgggtggctttggtttacactgcgcgacgcctgacatgcagttaaccgggatcgaaattgcaccagaggccattgcctgtgcgaagcagtcagccgctgaactgggcttaacgcgtttgcaatttcaggcgctggactctacgcagtttgccaccgctcagggggaagtgccggagctggtgctggttaacccgccgcgccgcggcatcggtaaaccgctgtgtgattatctctcaacgatggcaccgcgttttattatctactccagctgtaacgcccaaactatggcgaaagatatccgcgaactgcctggttatcgcatcgaacgggtacagctttttgatatgttcccgcacaccgcgcactatgaagtgctgacgctactggtgaagcaataaaaaagccgcaggtgcggctttctgaatcttactgtgggaaccactggtcattgattttctgatatgtaccgtcagctttaattgctgccagcgcgttattcagtttttccagcagagctttgttatccggacgtacagcgatacccaggccggtgccgaagtattgcggatcggtcactttttcagtagcaacgcccagttgcggattggttttcagccattcgtttaccactgcggtgtcaccaaatacgccatcaatacggccatttttcagatcgataaaggcattctgataactgtcataggagacagttttcacttccgggtgctgatcctgaatatatttctggtgcgtggtgccgttttccatcccaatacgtttgcctttcagatcggcaaacgttttgtaggtatcttttttggcaatcacgacggctgagttttcatagtagggcgtggtaaacgatacctgtttgctacgctccggcgtgatatccattccggagattacggcgtcatattttctgaatttcagtgacgggatcaggctgtcgaaagcgtgattagtaaaagtacattctgcctgcatttgtttgcacaaggcttttgccaggtcgatatcaaagccgacaatctcattattagcacctatagattcaaagggtggataggtggctgaaacgccaaaattgattttctctgcggcagaagcaccgaaagtaaaagaagcaagtaatgcggcaagaactaactttttcatgatggaactcccgtctgtcaatcttatgatttttggccgtgtctgcggcatgggataacaatgccatcaagtgaatttatatgcaataaatatgagtaaataatttatatgaaataaaaaaagacggacagcttagtgggttgtccgtcttcataataagaatttatgcactatgtaggccggataaggcgtccacgccgcatccggcatcagcatgcagctacattaattccgccgttcgaatgccagtgctttacgctcgatcagacgcatcatcagcgtcagcaggccgttgacgaccaggtaaataatccccgccgcgccaaataccattacatcgtaggtgcgtccgtacaacaactggctgtatcccatcacttccatgagcgtaatggtgtaagccagagaggtacttttgaacaccagcaccacttcgttggaataagaagagagcgagcgtttaaacgcgtacggtagcaggatcgccagcgtatcttttttgctcattcccagggcgctacaggactgccattgaccttccgggatcgcgcgaatcgcaccgtaaaacagctgcgtggtgtacgccgcactgttcagcgacaacgcaatcagcgcacataaccacggttctgacaacaaatgccacagtgccggatactcctgcaacgttgggaactggcccggtccgtaataaatcaggaagatctgcaccagcagcggcgtaccggtaaacagcgtgatatagccccgcaccagccacaccagcaccggcgttttcagcgtcaggatgatggtaaaaatcaatgccagaatcagtgccacaatcagcgaggcaacggttagcgtcaggctggtgtgcagccctttcatcagttcgggtaaatactcaaacattagctgggcctccgctcaaaacgtgtcgcgcgcaggtcaatgcgtttgagaatgtactgactgagcagggtgatcaccaggtaaatcaccgccgccacaatgtaccaggtaaacggttcctgtgtacgggtagcgatgcttttggtttgtagcattaaatcattcacactaatcaaactgaccagcgcggtatctttcagcagcaccagccactggttaccgagacccggcagcgcatgacgccacatctgcggcatcaccagacggaaaaagatagccgatttcgacagccccagcgcctgaccggattcccactgacccaccggcaccgcttttaatgcaccacgcagcgtttgcgaggcataggcggcatacagcagtgacagagcgatgacaccacaaaggaacgggctaacgtcgaagttctcaatgtccatctgcaccgggatctgcacgaacccaagattgatagtgaagccatccgaaagcgtcagcagcagctgcgaggagccaaaatagataaacagcaccaccagaatttctggcaggccacgcagaatggttaccagcgctgaacctgcccacgcgacaggacgccatttcgcagactcccataccgcaaagaacatcgccagcgccagcccgacaatcaatgcacaaacggcaaggccgacggtcatcccggcggcgcttgctaaaggaaaaaattcattcatcaggaattacttctggaaccatttgttgtagatggtttcgtaagtgccatctttcttcactttttccagcgcagtgttgagtttctgctgcagttcagtgttgccctggcgtactgcgatgccgaggccagtaccgaagtaatctttatcggtcactttatcgcccactgccgccagtttcgggttatctttcagccattctgttaccactgcggtgtcaccaaatacgctgtcgatacgaccgttttgcagatccaattttgcgttctggtaactgtcatatggcacggtagtgatttccggatgcttatccataatgaacttctggtgtgtcgtcccgttctgaacgccgacttttttgcctttcagctgatcaacactggtgtatttgccttgctgacccacaaacagggcagagttgtcatagtacggggtggtaaacagcacctgcttttcacgctccggagtgatatccatgcccgccatcactgcttctacgcgacggaatttcaggcttgggatcaggctgtcaaacgcctggttagagaaagtgcaggttgcatcaatctctttacacaatgcctgcgccaggtcgacatcaaaaccaacgatctggttgtttgcatcaatcgattcaaacggaggataggaggcttcggtggcaaaacgaatggtttcggctgctgtggcggaaagactaaaacctgcaattaacgcggcaatcagaacttttttcattgttgttatcccgaatcttagtgagagagatagtttttaaatgcttcggtttgcggctcggtaaagcagctcgcgtcgccttgttctacgatatgaccgttttccatatacaccactcggctggcggttttacgcgccacttcaacttcgtgggtgacgatcacctgggtaatattcgtttctgccagctcacgaatgatgctgacgatttgtgccgtaatttcggggtccagtgcggcggtcggttcatcgaacagcagtacctgcggttccatcattaacgcacgggcaatagcaacacgctgctgctgacctccagaaagatgcagcgggtaacgatcgctataaggtttgagacgcagacgttccagcagtttttctgcacgggccagcgcctgatctttactcaaccccagtacacgacagggcgcttcaatcaggttttgctgcacggtcagatgcggccacaggttgtattgctgaaacaccatgccaacgttacgacgcaaatcgcgaatcgctttgtcagagggggttttggtgaaatcgaaatggttgcctgcaatgttgagcgtaccggagcgcggcatctcaagcagattgagtacacgcagcagcgagcttttacccgcgccactggggccaagtaacaccagcgtttcgccctgtgggcaatccagcgtgatatcgaacagcgcctgatgcgcgccgtagaagcaattaatgccgtttaattgaatactcattgacactcgtatactggcagtctgatagctattgaggtcgaagatagtacctttgacagaataattatgcaatatttctgctttaaaagttaaaagcaaagcgcattattcaataaacatagcacaaaataacgggggcggtggtcggcgagcataaatgtcggcattcctcacgaaatgccggacaatttacggggtttattggttgatcaagacgttagcgattctcgatggactgacggagcgtacccgctgtggcatgaacgctaccgcctaagtagcgcacatcgtcgatgacccaacactggccttcctgaatcattaacacttcatcctgccagccctggtcaccctgcttgagatccacgcgcaatggaatgttacgggcatcacgattagggatagtcgatgcactggctacgtgggcgctgtctggcaaggtggttcgactggagaacggatcgctgcttaacaattcacgatgactattatcgcggctggcatcgctaagtagggttgccagtttgtcactcaaataggggcgcagagcggtaatgtcattgctgcgatgttgaatgcggtagtcatagaactgttgagccacactatcaggccccccctggacacaggaaccggtgcgggggccgttatctttataagctggcgtgacggtggtacaggcactgagtagcagtgcgcaagggataagcatggtcaatttgctatagcgcatgatgatttccttataagcgaacaccttgaaagcgttctacgataataatgatatcctttcaataatagcgtatcagtccgataatgctttgaagatcgaaggcttagcaaacaaggagatcgatcatgcaattttctacaaccccaactctggaaggccagaccatcgttgaatattgcggtgtggtgactggcgaagcgattttaggcgcgaatattttccgtgatttctttgccggtatccgcgatatcgttggcggacgctccggtgcctacgaaaaagaactgcgtaaagcgcgggagattgcctttgaggagctcggctcccaggcgcgagcgctgggggctgatgccgtcgtcggtattgatatcgactacgaaacggtcgggcaaaacggcagtatgctgatggttagcgtcagcggtacggcggtgaaaacgcgtcgatgagaagagtcttctggctggtcgctgccgctctgttactggcagggtgcacaggcgaaaaaggcattgtcgagaaagagggatatcagcttgatacccgacgccaggcgcaggcggcgtatccgcgcattaaagtgctggtgatccactacaccgcagatgattttgatagctcgctggcgacactgaccgataagcaggtcagctcgcattatctggtccctgcggtgccaccgcgatacaacggtaaaccgcgcatctggcaactggtgccggaacaagaactggcctggcatgcggggattagcgcctggcgcggggcaacgcgccttaacgacacctctattggcattgagctggaaaaccgtggctggcaaaaatcggcgggagtgaaatattttgccccgtttgaaccggcacagattcaggcgcttattccgctggcgaaagatattattgcccgttatcacatcaagccggaaaacgtagtagcacatgcggatattgcgccgcagcgcaaagacgatccggggccattattcccctggcagcaactggcacagcaggggattggtgcatggccggatgcgcagcgggtgaacttttaccttgccgggcgcgcgccacacacaccggtagagaccgcgtcattgctggagcttttggcgcgttatggttatgacgtaaagcctgatatgactccgcgcgagcagcggcgcgtgattatggcgttccagatgcatttccgcccgacgttatataacggcgaagcggatgcagaaactcaggcgattgccgaagcgttgctggagaaatacgggcaggattagcgcggcagttttccgtggtcgcgcagccaggcggcagttttctcgataccttcatccagggtaaggactggctgataacctagctcttcctgcgcgcgcgtaatatccagcgtaaagtcaaaattcaacttggagacgccgtagtgggtcagcggcggctcttttgctgacttgcggcctaaacgctccatgctgcgggcgatcatatccagcatcgggtaagggacggaacgaatacgacagtcaatattcaattcgtctatcagcttctgcacgatgctgcgcagtgtgcgatgctcgccgttggtgatgttgtacacacgcccggaaggtagcttatcgcaggcttcctggcttgccagccacatggcgtgcacggcattttcatagtaggtcatatcgaccagcgcactgccgccatgcggtaacagaatactgccgtagtgatgcatcatatgcgccagacgagggataaagactttatcgtgcggtccgaacagactttgtgggcgcagaatagtaaagcgcgtttgtggattcgcctgcgaaagcatattgatcacttcttcgctggctgctttgctgcgggcaaactcgttggcgaagcggtgagggcgaaaatcttctttaatatcgcgatggtggtgataatcgaagtacagggagggagaagagatatgaataaagttacgcacaccccaggcgacagcccattcacccaggcggcgagtggcacgaacgttagccagatcgaaagcctgttgtgtcccccagggcgaggtaaagctggagcagtgccacagcgtatcaatgcctgcgagcatcactttagcttgtgatgagaccagctcggtcagatccgccggaacaaactctgcgcccattttttccagcaatttacccattgcctcgttgcgaccggtcgctcgcacgctgatgcctttctggcataaaaactctaccgcgtttcgacctaagccgctggtggcgccggtaaccagtaccttcatatcaatccactgttgttgagaaaataacgtgcgcattcttccgtgatttcctccatgatgcaatgggaaacatgaaagaataacgcaggttttgtcgattaatctgtgctttgttctgccagtctggcgattcgttttgccattccgcgaaaaataaacagatgcgcggggatcatcaataaccagtaaaacaaccctggcataccgtgcggatgccagaatgcgcgaacatcgatagtacgatagtcacctttatcttccagggtaaaacacagtcgtcccagccccggcgctttcatgccaaataacagcgtaagttgtttttgcggttcaacgacaatcactttccagctatccaccgcatctccggtctgcaaatattcacgctccgggcggcctttcgccagcttatgaccgatcgcgcggtccatcaacgcccgggtttgccacaaaatattgccaaagaaataacgctctttaccgccgatttgattcaccacctgccataaagccgcaaggctggcggacgttttaacggtaaaccccgcctgtttggcgaaataaccgtactccggtcgccagcgggcaaaggcctgagcgtcgtagccccagtcgctggagttgaccagcttttcttcctctttcaacgtgctacgtaccgcgtcatcgaaagcgatcagccgttgtgggatgagcgcacgtagcgcggtgtcatccgccagcagatcgtgtttcagcccctgaatcaacgccctggcggtggtgggcggtactgaagtaatcacattaagaaaccacaccgaaatccagcgggtggggagggggatggggagcaaccagcggcgcttaccgctcaccgccataaaatgttcaaactgttgctgataactgagcacttctggtccggcggcttcgaagatgcgatgttcgctggctggatggtctaacagcgccaccagatagtgcagcaagttttccagcgcgatgggcgtggtgcgtgaacgaacccagcgtggcggcgttaacactggcaggttgtagaccatatcgcgcatgacttcgaacgccgctgaacctgcaccaacgattattccggcacgcaattcggtcaccgggacacccgcttcacgaagaatatccgccgtagcctgacgggcgcgcagatggtccgactgctcatgtggcggggcctgcaacgaactgagaaagattaattgctttaccggtacttcgcgcagcgcatcgcggacgttgagagccacctggcgctcctgagcgataaaatcaccgccttctcccatgctgtgcaccagaaaatagaccgtatcgatatcctgcaacagggccggaaggttatccggccagctgagatcgactttatggcaactgacatttgccagttgcagctttgcaagcctgtcgacatgacgtgccgccgccaggatctgatgcccctgctggctgagtgttcgcaccagatgctgaccaatgtagccactggcaccgagaactaaaatgcgttgcggcacgtctccctccttaacgcgccaggaatgcgcgccagtgggcggcgacttccgccagctgagcgcgcgagacgtcaagatgcgtcaccaggcggacaatcggcgaggcgttaatcagtacgtttctcgctttcatgtattcgcctaacgcggcagcattttcttccccgacgcgaacaaacagcatattggtgtcctgacgcatcacatccgcgcctgcttcacgcagttgcttcgccatccaggcggcgttgtcgtggtcttcctgcaaacgtgcgacgttatttttcagcgcatacagcccggcggcagccagaatgccggactggcgcatcccgccacctgtcattttccgccagcgaatggcacgtttaatgtaatcacgattaccgacgagtaatgaaccgactggcgtcccaagacctttcgacaggcaaatggtgaacgagtcacaatattgtgtgatctctttcagttcgcagccgtaagccaccacggcattaaagatgcgcgcaccgtcaacatgcagcgccagattgcgcttgcgggtaaattcccatgcctcttttaagtattcacgcggcagcactttgccgttgtgggtgttttccagactgagtaatttggtgcgggcgaaatggatatcgtcgggtttgattttcatcgccactttatccagcggtagcgtgccgtcggcagctgcgtcgatgggttgcggctgaatactgcccagcactgctgcgccaccggcttcaaacagatagttatgcgcggcctgaccgacaatatactcttcgccgcgttcgcagtgactgagcagagcgaccaggttagcctgggtgccggtcggcagaaaaatggcggcttctttaccggaaagctctgccgcatagtcctgcagagcattaacggtagggtcgtctccgtaaacgtcgtccccaaccggggcggccatcattgcttcgagcatggcgcggctcggtcgggtaacggtatcactgcgtaaatcaatcatggcatgtccttattatgacgggaaatgccaccctttttaccttagccagttcgttttcgccagttcgatcacttcatcaccgcgcccgctgatgattgcgcgcagcatatacaggctgaaacctttggcctgttcgagtttgatctgcggtggaatggctaattcttctttggcgacaaccacatccaccaacaccggaccgtcgatggagaaggcgcgttgcagagcttcatcgatttcagacgctttttctacacgaatacccgtaatgccgcaggcttcggcaattcgggcaaagttggtgtcgtgtaattcggtgccgtcagtcaaatagccaccagctttcatctccatcgccacaaagcccagcacgctgttattaaagacgataattttcactggcagcttcatctgcactaccgagaggaaatcgcccatcaacatgctaaaaccgccatcgccgcacatggcgaccacctggcgttctggctcggttgcctgcgcgcccagcgcctgcggcatggcgttagccatcgaaccatggttaaacgaacctaacaggcgacgcttgccgttcatttttagataacgtgccgcccacaccgttggcgtaccaacgtcacaggtaaagatggcgtcatcggcggcaaaatgactaatttgctgcgccagatattgcgggtgaatggctttctcgctcggtttagctaaatcatccagccctttgcgggcgtcgcggtaatcttccagcgctttatccagaaacttgcgatcggttttttcttccaccagtggcagcaatgcccgcagggttgatttgatatcgccgaccagcgccatatctaccttgctatgcgcgccgatgctggctgggttgatatcaatctgaataattttggcatcggtcgggtagaacgcgcggtagggaaactgagtaccgagcagcactaacgtatcggcgttcatcatggtatggaaacctgacgaaaagccgattaatcccgtcattccaacatcatatggattatcgtattcgacatgttctttaccgcgcagggcatgaactataggcgctttaattttcccggcaaactcaactaactctttatgcgcccccgcacagccgctgccacacatcagggcgatattgctggaataacgcagcagttgcgccagtttgcgtaactcttcttcttccggtgttactaccggctgtggcgcatgataccagtgggtagttgccccttctggcgcaggttttaacgccacgtcgcccggtaacacaacaacggaaacgccacggttaagcaccgctttgcgcatagcaattgccagcacttgtgggatctgctctgggctggaaaccagctcgcaatagtgactacattcgcggaataactcttgtgggtgggtttcctggaaatagccgctgccaatttcgctggagggaatatgagcggcaatcgccagtaccggaacgtgattgcggtggcaatcgaacaggccgttgattaagtgcaggttgccgggaccgcacgatccggcacagaccgccagttctccgctaagttgtgcttcagcgccagcggcaaacgccgccacttcttcatgccgggtggacacccactcgatggtgcccatgcgattaagactgtcactaagaccgttcagagagtcgcccgtgactccccagatgcgtttcacgcctgccgattcgagtgttttggcgatataagctgcaaccgtttgtttcatggttctccatctcctgaatgtgataacggtaacaagtttagttcatctgacggagggggaagggatgggagaaaaaggaggcactaacggttaaatagcccgatgaaaggaatatcatcgggcatcaggcgattatgcgagaaccaaatccccctgcggatggcaggagcaggccagtacgtaaccttcagcgatttcggcgtcggtcagcgtcattgtgctgctcaccgtatattcaccggaaatcactttcgtcttacagcagccgcaaacacccgcacggcaggcggcgacaaccggaacgttattgctttccagcgcctccagtagcgtggtgccaaccggagcgtaaaattctcgtgccggttgcagtttggtgaatttcagaccgctggtcgccgcttccgctactggggtgaagaatttttctttaaagaaacgcgtcacgccgagcgctttcacttcctgctctacccaatccatatatggagcagggccacaggtcatcacggtacgtgaggctaaatcagggacacctgccagcagttcgcgagtgagacgaccagcgataaagccttcggtaacgttattttccgccaccagcgttaccggatagttacgccactcatcggcgaaaatcacatcctgcggtgtacgcacgttgtagatcacctgcacatcggcctgtggacggttcttcgccagccagcgacgcatcgacataatcggcgtgacgccgcagcctgccgccagcaacaggaatttatcttctgctttatcgtcgcaggtaaattcccccatcgcgtccgaaagccagagataatcaccgcgttttacatcgcgcgtcagccaccgggagccgacaccgtcatcaatccgccgcacggtcagggtgatgtattcactcacgcctggcgtggaggaaatggtgtaagcacgcagcgtttccgctgagtttcgcacgctgaccagcgcatattgcccggcgcgatatgggtagtaatcgtggcaaatcagggaaatcgtccacacatccggcgtttcttgcgtaatgtgatgaacctgcatccgccacgggcattgattcgttggcatcgtcatcgacaaactccttacgcgctcaacagttgcttcatgtcttcttcaacagtggtgatagaacgcaggccgaatttctcgttcagcaccgccagcaggtctggtgtcaggaaaccaggtgcagtcgggccggtgacgatatttttcacacccagagaaagcagcgtcagcagaatgacaatcgctttctgttcaaaccaggagagcaccagcgacagcggcagatcgttgactccgcagcccagtttctctgccagcgttaccgccagaataattgctgagtaagcatcgttacattgaccagcatctaccagacgcggcagaccttcgatatcgccaaactcaagtttattaaagcgatatttaccgcaagcgagggtcaggatcaggcagtcatccggcacgctggtggcgaaatcggtgaaatagtgacgctcgccgcgtgcgccgtcacagccgccaagcaggaagatatgacgcagtttttcacggctcaccagatcaatcagcgtatcggctgcgccaagcagtgtctggcgaccaaagcccacggtgatcaggtgcggaatttcgctgtacgggaagcccgccatctgttgcgcctgggcaatgactgcagagaaatcttcgccatccagatgacgcacacccggccagccaacgatgctgcgggtccagatacgatcgtcataagcgcctacggttgggtcgatgatgcagttcgaggtcatcacgatggggcctgggaaacgagcgaactccacttgctgattctgccagccgctgccgtagttaccgaccagatgcttgaatttacgcagctccgggtaaccatgcgcaggcagcatttcgccgtgggtgtagacattaacgcccgtgccttcggtctgttccagcaggttgtagagatctttgagatcgtgaccggaaatcagaatgcatttacccgccgtcgctttgacgttgacctgagttggcgtcgggtgaccgtatttaccggtttcgcctgcgtccagaatgctcatcactttgaagttcatctggccgatttccattgaacactcaagaagcgcgttcatatcggcaggccaggtccccagccacgccatgattttatggtactgggcataaatatcgttgtcgtattgaccgagaacatgcgcgtgttccatataggccgccgcacctttcaggccatacaggcacagtagacgcaggccgagaatgttttcgccaatcgccgctttatctttgttaggggtaaattctgctgcctgacgttgcagctcgccgagatcgtcgctcaccagttgcaggtcagccatcgggttatcgacgcgggcgttggcatctacagccaggcattgtgctttcagcgcctcgcgcagggcaatcgcttcacgagcgtagccgacaatacgcggagaatcgaagttaacgttggtcagggttgagaaaaaggcacgtggcgcaaagctgtctacatcgtggttgatgatgccgtattcacgtgctttcactgcccaggccgaaagcccttgcagcgccgcgatgagtaaatcctgaaggtcagaggtttccgccgttttaccacacatcccctgcgcgtatgagcagccgtttcctgccggagtacggatagtttgttcacattgcacacaaaacatgatcacaccttttaaagttatatttaatatacatgtttaaggttaagacgcttaacgcggggataaaagagatttttaatgcaactttaagggagattgatttagcgcaattttggcggcagagatctaccgccagagaggtattatgcagagaaaaaggcgatgagaatcggcactaacagactaagaataaaaccgtgaacaatcgccgccgggaccatatccagcccgcctgtacgttgaagaacgggcagggtgaaatccatcgacgtcgcaccgcataagcccagtgcagtagagcggctacggcgaatcagcctagggatcaacataattgcaatcagctcacgggccagatcattaaaaaacgccgcgcttccgattaccggaccaaaagattcggtcaataaaataccggaaagagaataccagccgaaaccggaggccattgccagcgcggtattaatgggaagatcaagaataaaggcgttaattaaaccaccaattaatgaactggcaaccaccaccacggcgacaatcattccccggcgattaaggacaatctgctttaaggtcatgccattattgcgcaactgaataccgacgaggaaaagcagcagaattaaggtgtattcactggcttcggtcgcgtgttgtaagaaagccagtccactcaggccaatggcaaaaccaatcactactacgccgcacagttttagcgactccagcgccatcgcaatacgcgacgggagtttttcttgctgatggtgattgcgccatggcaggccgcgctccagccacatcagggcggcaatattacacagtaaaataacggtaatactgacggcagaataatgcagaatcgccaacaggttactggcgaggttatcgagaaacgccagactgatacccataaaaaagagaataaggtaaaccatccagcttaatagctgattaataactcttaatgcagctttttggcgaagcggaatgaggtaacccacaatcaggggaaccagaatgattaacagcccagaaaacatgaaaacccagtccttgcaaagatgaagtcgaaatgcgcgatgacacactactgaaagcggaaggacgagtaaagttgcaattaaaaggaaatgttatgcataaggagcagtagagtattcgttttcatttaaagatgttcttgcgctttaattacaaaccgcaccagtgttggtggcgtcaaaatcgccgaggcgttccctgaaggccggggcagcccacatggatgtgggctgagggcgcgttttacagggatgttacctcgcgcccgacccggtagccgtaagggataagccgagggcaccgcgcagcggcgattttgttcgccagagcccgggggtgcagggggcggcggcgattggccgccccctgcacgctccttgcgccagtggcaatatgtggcttagctcatgaaaggagcgcaacaagatgatgaatcaacatataacaacatcttaaaaaaaggcctgacattgcgccaggccttctgcgttaattaattacgcttttccagtagagtccggtaaatcagaccaccgataataccgccgacaattggcaccacccagaagaaccacagttgctctaatgcccagccgccctggaatatagcaaccgcagtactgcgcgccgggttaacggaagtgttagtcaccggaatactgattaagtgaatgagggttaaggccagaccaatggcaattggcgcaaaaccagcaggagcgaatttgtcagttgcgccgtggatcaccaacaggaaacctgcactcaataccagttcaactaccagcgcggaaagcatggaataaccgcctggtgaatgctcgccataaccgttagaagcaaaaccgctggctgccgcgtcaaaacccgttttaccactggcaattaaatacagcagcgccgccgcaacaataccgccgacaacctgggcaattacatagccaacgacttcttttgccgggaaacgtccgccagcccataaaccaatagtgaccgccgggttaaaatgaccaccagaaatatgaccaacagcaaaggccattgtcagaacggtcagaccgaacgccaacgccacgccggcaaaaccaatgcctaattccgggaagcttgcggccagtacggcactaccacagccgccaaaaacaagccagaaagtaccaaaacattcagctgctaattttctgaacatatccacctcaattaaaaattgaccctgtgaaaaatatggtcgttttatagggtcgtcgtaaaaaagtgacgacggaaataatgcgcggctattttaaaaacgaaggcaagtcattcaccagataaataaatccagtaaatttgatttagggcaacagcgggttgccccatatagtcatttgtctgattgacagtgtagtgcaagcgaaagatttaatcctttaggcgtaataaaaaataatttatcatgctaattatttgattttgttgtttttgcagacttgtcagcaagagggagtataacgcgattattcgctcatttttcagacatttgccatgcttaaatgtgatgtcatcacgtattagcatggcctttcccgttatactgccagcgtaaaggataagtcacatatttctggaggggatatgattcttgagcgcgttgaaattgtgggttttcgcggtatcaaccgtttgtcgttgatgctggaacaaaacaacgtcctgattggggagaacgcgtggggtaaatccagcttgctggacgccttaaccctgctgctatcgccagaatcagaactctaccattttgagcgcgacgatttctggttcccgccgggagatatcaacgggagagaacatcatctgcatattattttgaccttccgcgagtcgctgccaggccgacatcgggttcgccgctatcggccgctggaagcgtgctggacgccatgcaccgatggttatcaccgtattttttatcgtctggaaggggagagtgcggaagacggtagcgtgatgacactgcgcagttttctcgataaagacggacatccgattgatgttgaggatattaacgatcaggctcgtcatctggtgcgtttaatgccggtgctgcgcttgcgtgatgcccgttttatgcgccgtattcgtaacggcacggtgccaaatgtccccaatgtggaagtcaccgcgcgccagctcgatttcctcgcccgtgaattatcctcacatccgcaaaatctctctgatgggcagattcgtcagggactttccgcaatggtgcaacttcttgagcattatttttctgagcagggagctggacaggcgcgatatcgtttaatgcggcggcgagccagcaatgagcaacgaagctggcgctatctggatatcatcaaccggatgattgaccgacctggagggcgctcgtatcgggttattttgctcggcctgtttgctactttattgcaggcaaaaggcacattgcgactggataaagacgcccgtccattgttgctgatcgaagatccagaaacccgtttgcaccccattatgctttcagttgcctggcatctgttgaaccttctgccattgcagcgcatcgctactaccaactcgggagagttgctttcgttaacgccggtagagcatgtttgccgactggtacgagagtcctctcgcgttgccgcctggcgtctgggaccgagtggcttgagtaccgaagatagccgacgcatctcctttcacattcgttttaaccgtccgtcatcgctgtttgcccgctgttggctgctggtggaaggggaaacggaaacctgggttatcaatgaactggcgcgtcagtgcggacatcattttgatgccgaagggatcaaggtcattgagtttgcccagtccggactaaagccactggttaaatttgcccgccgaatggggattgaatggcatgtactggtcgatggcgatgaagcagggaagaaatatgccgctacggtacgcagcctgttgaataacgatcgggaagccgaacgagaacatttaacggcgttaccggcgctggatatggaacattttatgtatcgccagggattttccgatgtgttccaccgcgtggcgcaaatcccggaaaatgtaccgatgaatctgcgcaaagttatctcgaaagcgatccatcgctcttccaaacccgatcttgccattgaagtggcaatggaggccggacgtcgtggtgtggactccgtaccgacgctgctgaaaaaaatgttctcacgcgtgctgtggctggcgcgcggtcgggccgactaactacaaaacatcgtggccatttgtggctgaatagcgtcgagcatctcatagcgccgacggtattcagcccgttttttactggcgatttcggcaatctcttttcgtgctatctgtgctggaaggcggtaatggcgttcagcatcacatacgccgccaaccgattcccagaaagcgttgtaatcggcatggatcttgccttctttatcgcgataacgcaggctgcggtaaatatgcgtttcattgctgacggcaataatctgctctacctgcaaacgttgggcaaacagacaggccgcttccatcacgaggcgtttgggaaatagcccgtggcaggctttcgtcgcattctggatttcctggtgtggaatttcccattttgcgccttgcagtccgccaataaacatcgtccttttcccctgatattcacacagggtaaaagtgagctctgccagaggaataccttcgctgttgcggaacaggatggtgctgtcaccttctttatccattgagatcatcatggtcagctcaagcgtgaactgctcgccgtttttgccttccagcttcgccagttgcagcccgggggtattcaaatataagctgaattcttccgccgacatacacccgcggagtaacgcataatggtaacgtaacgcctccagcaattgcttacggctaagattcgccgcaaggtaagggcgatgtagacgtacaggcagtcgcggctggcgcgttaacaacacattgagattaggccagtgggaaagttcgttcatccactcaacgcttaaacgcggcataatcaacgagcgcagcaaaaatttctggcgaaaactacggcgatgccagaatttacccggccgacactgtcctcgtgccagactaagaaaaagtgacaggctgctgagagattcagatggcgtaaaggtccgttcagttagctgcgacatattcatgaaatcaatggttatacatgacgtcgatttaaccattgcgtatcttaaccaaacatcaatagtgtgattattaacgtaaattttagtgttttgttgatatttcgttgaagttaatgacccggattggcatatggagtattcagaatatttatgaaaaagcggaaaaccgtgaagaagcgttacgttattgcgatggtgatagtcatcgccgggttgattacgttatggagaattcttaacgcacccgtgccgacttatcagacgctgattgtgcgccccggtgatttacagcaaagcgtgctggcgaccggaaagctggacgcgctgcgtaaggttgacgtgggcgcgcaggtcagcggtcagttgaaaacgctgtcggtggcgattggcgataaagtaaaaaaagaccagcttttaggggttattgatcctgaacaggctgaaaaccagatcaaggaggtggaagcaacgctgatggagctacgcgcgcagcggcagcaggcggaagcggagctgaaactggcgcgggtgacgtattcccgtcagcaacgtcttgcacaaacgcaagcggtttcacagcaggatctcgataacgccgcgacggagatggctgtgaaacaggcgcaaattggcaccattgacgcgcaaatcaagcgcaatcaggcctctctcgatacggctaaaaccaatctcgattacacccgcatcgttgccccgatggccggggaagtcacgcaaatcaccactctgcaaggccagacggtgattgccgcacaacaagcaccgaacattctgacgctggcagatatgagcaccatgctggtaaaagcgcaggtttctgaagcggatgtaatccacctgaagccggggcaaaaagcctggtttacggtgcttggcgatccactgacgcgctacgaggggcaaatcaaggatgtgctaccgacgccggaaaagattaacgacgctattttctattacgcccgttttgaagtacccaaccccaatggtttactgcggctggatatgaccgcgcaagtgcatattcagctcaccgatgtgaaaaatgtgctgacgatccctctgtcggcgttaggcgatccggttggcgataatcgttataaagtcaaattgttgcgtaatggtgaaacacgcgagcgtgaagtgacgattggcgcacgtaacgataccgatgttgagattgtcaaagggctggaagcgggcgatgaagtggtgattggtgaggccaaaccaggagctgcgcaatgacgcccttgctcgaattaaaggatattcgtcgcagctatcctgccggtgatgagcaggttgaggtgctgaagggcatcagcctcgatatttatgccggtgagatggtagcgattgtcggcgcttcgggttctggtaaatcgaccctgatgaatattctcggctgcctggataaggccaccagcggcacctatcgcgtcgccggtcaggatgttgccacgctggacgccgatgcgctggcgcaactgcgccgcgagcatttcggctttattttccagcgttaccatttgctttcgcatttaaccgccgagcagaacgttgaagtacccgctgtctatgccggtcttgagcggaaacagcggctgcttcgcgcccaggagttactgcaacgactggggctggaagaccgtacagagtattacccggcacagctttcgggtggccagcaacagcgcgtcagcatcgcgcgggcattgatgaacggcggtcaggtaattcttgccgatgaaccgaccggcgcactggacagccattctggcgaagaggtgatggcgatcctgcatcagctgcgcgatcgcgggcatacggtgattatcgtcacccacgatccgcaggttgctgctcaggccgagcgggtgatcgaaattcgcgacggcgaaattgtgcgcaatcctcccgccgttgaaaaagtgaatgctactggcggaacggaacctgttgtcaacacggcgtctggctggcggcagtttgtcagcggttttaacgaggcgctgacgatggcatggcgggcgctggcagcgaataaaatgcgtactttactgaccatgctggggattattatcggtattgcgtcggtggtttccattgtcgtggtgggcgacgccgctaaacaaatggtgctggcggatattcgttctattggtacgaatactattgatgtctatcccgggaaagattttggcgatgacgatccgcaatatcagcaggcgctgaagtacgacgacttaatcgccatccaaaaacaaccgtgggttgcctctgccacgcccgccgtctcgcaaaacctgcgcctgcgttataacaatgttgatgtggctgccagtgccaatggcgtgagcggcgattattttaatgtctatggcatgaccttcagtgaagggaacacctttaatcaggagcagctgaacggtcgtgcgcaggtcgtggttctcgacagtaatactcgccgccagcttttcccccataaagcagatgtggttggcgaggtgattctggtcggcaatatgcccgccagagtcattggtgtggcggaagaaaaacagtcgatgtttggtagcagtaaagtgctgcgtgtctggctgccatacagcacgatgtccgggcgagttatggggcagtcgtggctgaactccattactgtcagggtgaaagaaggctttgacagcgctgaggcggaacagcaactcacgcgtttactttcactgcgccacggtaagaaggatttctttacctggaacatggatggcgtcttgaaaaccgttgaaaagaccacacgtactttacaactgtttctgacgctggtggcggtgatttcgctggtggtgggcggtattggtgtaatgaatattatgctggtgtcagtgaccgagcggacgcgggaaattggcattcgcatggctgtaggtgcgcgagcaagcgatgttttgcaacagtttttgatcgaagccgtactggtttgcctggttggtggcgcgttgggaataacactgtcactgttaattgctttcaccttgcagcttttcttacccggctgggagattggtttttcaccgttagcgctgctgctggcgtttctctgctcgacggtcaccgggattttatttggctggttacccgcacgaaatgcggcacgactggatccagtagatgctctggcacgagagtaatttttgagataaaaatgccagccgatcgggctggcattttgcctttaggatgtacacaatgagacagaagagctatgcgactgccgcttctacttcgacgggcacaataacactggcgtgattgccttttggcccctggtggacatcaaactgaacggattgtccagcttttagcgttctgtaaccatccatctgaatggtggaataatgagcgaaaatatcttcgccgccgccttcagggcagatgaaaccaaaccctttggcattgttgaaccacttaacagtacccttttccatgcttcgacatccttcgcaaatcttatacaagtaagatggaataaaccggggtcagagagggggctgttcaaaacctcgccaactctagaaatacaatttagagaattagggcgagccgtcaagcatttgacaggggccagggggcaggtatgaatcaaaaatttgaagcagttaacgctattgacaggaatgtgacagatgtcgctgatgccaacgatagatgatagttatctatcatgtggagtagattggtcaggcaaataagctcttgtcagcggcagggcgttctgccgataaccgtaaccgaagatgataactgacaatgggtaaaacgaacgactggctggactttgatcaactggcggaagaaaaagttcgcgacgcgctaaaaccgccatctatgtataaagtgatattagtcaatgatgattatactccgatggagtttgttattgacgtgttacaaaaattcttttcttatgatgtagaacgtgcaacgcaattgatgctcgctgttcactaccaggggaaggccatttgcggagtctttaccgccgaggttgcagaaaccaaagtggcgatggtgaacaagtacgcgagggagaatgagcatccattgctgtgtacgctagaaaaagcctgaatgcaggcataaaaattgggggaggtgcctatgctcaatcaagaactggaactcagtttaaatatggctttcgccagagcgcgcgagcaccgtcatgagtttatgaccgtcgagcacttgttactggcgctgctcagtaacccatctgcccgggaggcgctggaagcgtgttctgtggatttggttgcgctccgtcaggaactggaagcctttattgaacaaaccacacccgttctgcctgccagtgaagaggagcgcgacacacagccgacgctgagttttcagcgtgtactgcaacgtgcggtcttccatgtccagtcctccggtcgcaatgaggttaccggtgcaaacgttctggtcgctatctttagcgaacaggagtcgcaggcggcatatctgttgcgcaaacatgaagtcagccgtctcgatgtggtgaactttatctctcatggcacgcgtaaagacgagccgacacagtcttctgatcctggcagccagccaaacagcgaagaacaagctggtggggaggaacgtatggagaatttcacgacgaacctgaatcagcttgcgcgagtgggcggaatcgacccactgattggtcgtgagaaggagctggagcgtgctattcaggttctctgccgtcgccgtaaaaacaacccgctgctggtaggggagtctggtgtcggtaaaaccgcgattgcggaggggcttgcatggcgaattgttcagggcgatgtgccggaagtgatggctgactgtacgatttactctctcgatatcggttctctgttagcgggcacaaaatatcgcggcgactttgaaaaacgttttaaagcgttgctcaagcagctggagcaagacactaacagcatcctgtttattgatgagatccacaccattatcggtgcgggtgcagcgtctggtggccaggtcgatgcggctaacctgatcaaaccgttgctctccagcggtaaaatccgcgtaattggttcgacaacctatcaggagttcagcaacatttttgagaaagaccgtgctctggcgcgtcgcttccagaaaattgatattactgaaccgtcaatcgaagaaactgttcaaattatcaatggcctgaaaccgaagtatgaagcgcaccacgacgtgcgttataccgcaaaagcggtgcgtgcggcggtagagctggcggtgaaatacattaacgatcgtcatctgccggataaagcgattgatgttatcgacgaagcgggcgctcgcgcacgtctgatgccggtaagcaaacgcaagaaaaccgttaatgtggcggatattgaatccgtggtggcccgtattgcacgcattccagagaagagtgtttctcagagtgaccgcgataccctgaaaaacctcggcgatcgcctgaaaatgctggtcttcggtcaggataaagccattgaggcgctgactgaagccattaagatggcgcgtgcaggtttaggtcacgaacataaaccggtcggttcgttcctgtttgccggccctactggggtcgggaaaacagaggtgacggtacagctttcgaaagcgttgggcattgagcttctgcgctttgatatgtccgagtatatggaacgccataccgtcagccgtctgattggtgcgcctccgggatacgttggttttgatcagggcggtttgctgactgatgcggtcatcaagcatccacatgcggtgctgctgctggacgaaatcgagaaagcgcacccggacgtgttcaacatcctcttgcaggtgatggacaacggtacactgaccgataacaacggacgcaaagcggacttccgtaacgtggtgctggtgatgaccactaacgcgggggtacgtgaaaccgagcgcaaatccattggtcttatccaccaggataacagcaccgatgcgatggaagagatcaagaagatctttacaccggaattccgtaaccgtctcgacaacattatctggttcgatcatctgtcaaccgacgtgatccatcaggtggtggataaattcatcgtcgagttgcaggttcagttggatcagaaaggtgtttctctggaagtgagccaggaagcgcgtaactggctggccgagaaaggttacgaccgggcaatgggcgcacgtccgatggcgcgtgtcatccaggacaacctgaaaaaaccgctcgccaacgaactgctgtttggttcgctggtggacggcggtcaggtcaccgtcgcgctggataaagagaaaaatgagctgacttacggattccagagtgcacaaaagcacaaggcggaagcagcgcattaatctgattgtctggtaggttggttaagtccgtgatctcgtcaggggttacggactttttatttatggggggaggaggttcagaccctttttttaatgatgatgctaagttattgataattagtgctgcgggtaggtaaggataaaaaagggtggcagcaggagattgagatggttttgctttattaacaacgggctaaacgtgtagtatttgagttcactgccgtacaggcagcttagaaaatgcagcgtttgtcactaaaacactggtcaacgttcactgccgtacaggcagcttagaaatggtatacctggaagttcgtcctgttaaacaggttcactgccgtacaggcagcttagaaagcctcaaaatcccttgcgtgtttttgctccccgttcactgccgtacaggcagcttagaaaataaagataataacacaatcgtgtctggatttgttcactgccgtacaggcagcttagaaaaggaaccgcgtcagccccctgcaaagctcattgttcactgccgtacaggcagcttagaaatggcgcgcctggaggacatcccggaagaccagcgttcactgccgtacaggcagcttagaaaggtaacgggtcaggccgaccgtggaataccgcgttcactgccgtacaggcagcttagaaaataaagcgatcgacgcggttccagccatagaagttcactgccgtacaggcagcttagaaatgatgcatcacaaacgggaagggtaacgggcgagttcactgccgtacaggcagcttagaaaagacatctgctcaatagaacgggtgatctcaagttcactgccgtacaggcagcttagaaaagatccagttcatcatccagcgcagactcttggttcactgccgtacaggcagcttagaaacgtcacccgcgcagcagtcacacgggcgcacggttcactgccgtacaggcagcttagaaaaccgccggggcggtttccccgatgaaaaggaagttcactgccgtacaggcagcttagaaagtggcgctagcaatgagatttgcggaaaaaaggttcactgccgtacaggcagcttagaaagtgctgcccgccagcgtggcgtaattgtcacagttcactgccgtacaggcagcttagaaaaaaaagttgcgccgcgtgaccggcactatagagttcactgccgtacaggcagcttagaaactgaacgttgaagagtgcgacctcactgccgtacaggcagtattcacactacgatagtgttagacgtttggtcgtgcaatgacactctcaacttcaaaccattagcgttagcacgcaataacaatcgtaataattgcgatggaaatcaattttcagcacataaatcaatgctgtactaagcccaataccttcaaatataaaataatcacaggatgtgtttatgtcttcgaattaccttacgccttccgatctcaaaaccattctccactccaaacgcgccaatatttattatctggaaaaatgccgggtacaggtgaatggtgggcgggtggagtatgttaccagcgaaggtaaagagtcgtactactggaatatccccattgcgaataccacggcgttgatgctgggaatgggaacttccgttacccaggcggcgatgcgtgaatttgctcatgccggggtgatggtaggcttttgtggtacggatggcacgccgctgtattcagcaaatgaagtggatgttgatgtctcctggctcagcccacaaagtgaatatcgccctacagagtatctccagcagtgggtttctttctggtttgttgaagacaaacgacttgctgccgcgaaacgttttcagttaatccgcctgacacatatcgataagcactggcccagctcgaaaatgctgcgtgaacacgcatttcaacctgatgttaatgcgctgcataccctcctgaatcgtactcgtgaagaaatagacgcggcagaaaaccatacgcagcttatgctcgtagaggccaaattgactaaagcgttatacaaaatggtcagtcaaaccgtggggtatggcgatttcactcgcgcaaaacggggcggtggtatcgatatggccaaccgcttcctcgatcaagggaattatctggcttatggactggcagcagtggcggcgtgggtaacaggtatcccgcacggtttagctgtaatgcatggtaagacacgtcgcggcgggcttgtttttgaccttgccgatctgattaaagatgctcttgttatgccgcaagcatttattgccgcaatggcgggagaagatgctcaggagtttcgtcaacgctgtattaatatctttcaacaagcggatgcgctggatgtcatgatcacctctctgcaggaaacggcccaggcactggctaaggctgaccaatgaatgtcctaattatctcacgctgtacgaaaaatgctcgcgtggaaagctgccgtattattgatcagtttgccgaacgcactggtgacgcagcatggcaaacggtgattactctggaaggcgttaatacactccgccgtttactgcgcaaaaccgccaggcgaaataccgcagtggcttgtcactggctgaagaagaatgggcaaacggagctgatgtggattgtcggcaatattcgtcgctttaatgctcaaggccgcgttcccacaaatcgaacaacgcaaatcagcctggtgaacaaagaagaaaatcgctggcagtgcgcggaaagtattgcactgctggcggctatcgctgggctatttcatgattttggtaaatcaggacgcagctttcagcaaagcctgactcaaaagaatacccgcagttatcaaccttaccgacatgaatggatctcactgcggctctttcaggcgtttgtcggtgatcggcccgacgatgtgtggctggcgaagcttggcgaactcacggcagatgatgaatctgcgattcttgagcgcctgcaaaaagacactcctcaattttcaaatagcccgttcagttcgctgcaaccattagccaaaacggtaggctggctgatcctttcccatcatcgaatgccggagaatctttctccacagtcggaacaatcatgtaaagggtgtgaaagttggctggagaagcaacttaatgctgactggaatgccgttaaccaccgcagagatgactggtcacaacaggattttgcgcacgtctggcagtttccatcaggaacgccgcttcaaagcgcgagctggcgggaaaaagcgcgtcagatagcccgccgggcaagcaacgcgctaggtttaaagacatatgggcagatggaacagttgttccccttacatatggcgcgtttttgtctgatgcttgccgatcattactattcctcaagcgatgcgcagcaaaaatggcaggacccggattatatcgtctgggcaaatagcgatcgccaaagcggcacgctcaaacaacgggtagacgaacaccttgtgggcgtcgcacatcatgcgtatctgcttgggcggcaactgatgcacacacgggcatcgcttccggcaattgcccgacataaaggttttagccagcgggccatagatgtgaattatcgctggcaagataaagcctgggatgtggcgcgagcgttacgtgaacgaagtcgtgaagagggatttttcggcgtcaatatggcctcgacggggtgtggtaaaacctttgcgaacgcccgcattatgtatgcacttgccgacgagcgagaagggtgccgctttaccgttgcgctgggattgcgcacgctgactttacaaaccggcgatgctctgcgcagtcggcttgggctgggtgaggatgagctggcggtactgattggttcggcggcagttaatcaactgtggcaacaggaaaaaatagacaatgattgcggaagtgcttcgcaagagtcgccggcagaggagcaacagttcgttaagtacgaaggcagcctgcataccgggacgctggaaaaatggttgaaggatgacagcaaacttaaggagttagtaagcgcgccgattctggtctcgacgattgatcatcttatttccgcgaccgagggcgtgcgaggcgggaaacagcttccggcgatgttgcgcctgttaaccagcgatttagtgctcgacgaacctgatgactttgatattgccgatcttcatgcggtatgtcgattgatgaactgggccgggatgctgggaacgcgggtattactttcttccgcgacgttaccgccaggtttgattcaggcgctgttcgcggcttatcttgctgggcgaaaaatgtggcaggcgtcttgtggtatcaacggcaggcccgtcaatatatgctgcgcctggtttgatgaaaaagatgctgatgccacgcaaatttacgacggacctgggtttcgtgatgctcatgccaaatttgttgcacgacgagcggtaatgctggctgaaaaagaacgattgcatttcgggcgtgtagcttcggtttcatcagcatcaggcgcgatacaagatgttaccgaaagtgtggcccagacggtgcatacgcaaatgctgaagttgcatcaggcgcatcgccagcgacacgaaagcggtaaaaccgtttcgctgggcctggtgcgcttcgcgaatatcaatccactggttgcggtgaccaaagccctgattgtcattccttcaccagaagatgtctgcattcattactgtgtttaccactcccgacacccgctggcggtgcgttcagatattgagaagcgactggatcgcgcttttactcgtcataacgaactcgatttctggaacaacgaagatatcgcagatgccttacataaccgtccggaatcgcaccatctgtttgtggtgttggggacatcggttatagaagtggggcgtgactgggatgcggactggggaattatcgaaccaagctccatgcgttcgataattcaatttgccggacgtattcagcgccaccgtagaaatgtgccgaccagtgagaatctggttattttgcgtagcaatatcaaatcattgcagaaaaaagcccccgcattttgtaagcctggtttcgaaacaaaagaacacttgctgaatagccacgatatttgcgaactgattccgatcgcggactaccggacgattaacgccttgccgcggatcctgtctgccaataatgccaacaaactggcggagctagaacatagtcgtttatccgccgaattgatgagcagtaaaagcaaacatgtggtggcggcgcaatggtggcgtgcaccgctaagctggaacggctggatgcagcgccagacgccatttcgttattcccctttgccggaggcggtgttttttctgcatatggatgatgaagaaagcgaagcgcgtttctattcccgcacgggcgacaacgagcgtaaagcgcaagggaatttcaggcgagaagaggtgagatgcgccagtggcgtcgtttgctggggagtgatggattaccaacacgttttgttggatttggctgaaaagcagagttgtgagatagcaagcgttggggaaaagtttgcggaagtgagagtacccgtcagtgaagaagatgcggtcgatgactggcgttatcacccatggcttggggtgtttcgcgccccgtgaaggggcgcgggctacctgtacggcagtttacaagtccgtatccggagatatctctatttctaagctgctcaaggcagtttgggtatgttagcgcttcaactattgcgtggcaaatattaagttgctttaatatcaccgatggtgattacatgagatttaataatatcttttagaagatatctctaggagagtttgtttgtgtgatcaccactggtgttgtcccttttgctgtgtatgtcagttgtactgaagccatgttgggctacggagatttttcagtgaaatcagggagcaacttcgacttgatggattaacgaaaaggagccgatatggaaaaaacggcgctaatacaatttattactgactacatcgcttcgcgaaggcaacccaaaatagatgcctttgaaaaagaagcagcaaagcggttggaacagggcgaggacgccagcgttattgctctggagcggcaggaacttgaagcacgctacctgccacgtaactggttaacggatgcggcgaaacgtgccgggcaaatcaaattagtcacccatggcgcaaaattcagtcatggtgattctaaggccagcagcttttatctggaaacctccgctaccgaaagctatttaaacacagcatcgttggcgaatgtcgctactgacgcgattggcaacgccgccgcactggacgtcgcaaaactgctacaaaccgatgtgaacggagattcactgcttgccagcctgaagcgtggtgattatcaggcattaagtacgtttgcagaggataaagtgcaactggagctgtgggtagctgggtttagccaggcatggacaactggacggccttccagccataaactggcgaaacaaatctatttccctgttgcggatggttatcacctgttatgcccactgttttccagttcactggcccaggcgatgtatgaaaagctaaccgccgggcgctttagtgaggaatcgaaagccattcgcgatgcccgcaaagcaggaaaatggcactcccagccagatatccggtttcctaatcttgccgaaatgcatttcggcggcacaaaaccgcagaatatttctttgctaaacagtgtgcgtggtgggcgcgtctggctgttgccgtcaatgccgcctgcctgggggccgctggatcgcgcaccacaaaaaatgcacagtatttttgccttacgcggcgatttcaatagggcggcttcaggcatcatagcccggatgacttacctgctgaaggttgacacaaataatgttcatatccgaactgtgcgggcgaaatatattgatgagttgatcgatttgctgttcatgcaggcatccgcttttcagcaagaaaaatggcagggatggtccgcacaatcaccagacttacctcgccaccaacaactttggctggacccgtggcgaagcctctcagatgagactttcaaacaggagcgtgagaaaaacgactggcaagtaactgtcgccgatgatttcgcacgctggctgaactatcgcctgaaaaaatccagttttgacgtaggcgctgtcgaacaaaaagagtggcgcagccagtctctgttcgctcaacggatgcgtgaaatggaagctgttttgcaggaggcgctgaaatgagttatctgctcttgttaccccatatacgcatcgaaaacgctaacgctgtctccgggttgacctggggattcccgtcgatgacccattttctcggttatgtccatgcgctttctcgcaaagtcgtggatgaatttggcgtaagttttgatggttgtgcggtagtaagccatgaacagcatattcaggcgtacagctctgggcgcgattttcagttcgctctcacccgtaacccattaaccagagaaggtaaaaccgcctcgttcaatgaagagggccgcatgcacttgacggtttctctactgattgaatgtaatggcgaaatcaccaatggtgaatatggcagaaaagttctttgtgactatctgaaaatgctttgccagagccacaaactggcgggcggcagcattgtcagtatgcgcgatccgcagctttttcatgcgcctgaagatgaaaagcaactgcgtaaaatcgtctggcggttaatgccgggttatgcgctttacgatcgcagtgaatggctggctgaacatcaccaacaacatcccgacatctcgttgctggatgcctggcttgatttcgccgcgattaaatatcaggccgaatctccggctgaagacaacagcgcaaaatgggtataccagccgaagccaatgcctggtttcctggtaccgttaatgtgtggctaccaacgcatttctcctgtttacgcacccggtgaagttgaaaatgcgcgcgacaccgtgacgccatttgcctttgccgaagcggtatatggcattggcgaatggcgcggattacatcgcactacagacttgcaagcgctgatgtggcgttaccgcacaacggacactggctactattgttcggcaacgccagttgttgatgattttacctttaatgaatatgacgatttagaataaggacataattatggcaaaggctcctgtagcaataaaaacggcgtcggtactggcatttgagcgcaaactggcaacctctgacgcggtaatgtacgcaggtaactggcaaggaaatgaatggcaacccattgagattcaggagaaagcggtccgcggaaccatctctaatcgcctgaaaaatgccattgtcagcgatcccacaaaactggatgctgaaatccaaaaagccaacctgcaacgggtggatgtggcttcgcttccggtagatacggatacgttaaaggtggtgtttacgctgcgtgtgctgggtaatttatccacaccgtcagtatgtaatgatatggcttaccaggaggcgctttccggggtcattgaaggttacatcagcgaacatggctttaaagagctgacgcttcgctatgcgctgaatctggcaaatggtcgttttctgtggcgcaaccgcattggtgccgaacagatccaggtgaaagtgactgctaacgagacttcatggacttttaacagccatgacttctctttacgtcaatttgaccagggacaggcagcggtcacgcagctggcggccattatagagcaaggattaagcgcaaaagagtgggtgatgcttaccgttgaagcgcaggttcgtcttggtgccgggcaagaagtttttccgtcgcaggagctggtactcgacagcaacagtagtaaaagtcgcgtgttataccaggtggcaggcattgccggtattcactctcagaagattggcaatgctttacgtaccattgatacctggcatccaaaggttgatgaattgggggctatagccgtggaaccttacggttctgtaaccagtcgcggtgtggcctgccgtcaaccgaaagaaaaactcgacttttataccttactggacaattgggtgactaaagggatgaaaccagacgttaagcagcagcactacgtgatggctgtgctgatccgtggcggtgtctttggtgagaaatcggaataaggagctgccaatggatcactaccttgagatccgcgttctgccagatcctgaattttcgagcgaaatgttgatggcggcgttatttgcaaaactgcatcgggtattaggtgcaagagggcaaggcgatatcggcgtgagtttcccggacgtaaatgttatgcctggaacgcatttacgcttgcatggtagcgcccaggcattgcaagaacttgaagcctcgacgtggcgtaaagggctgacagattactgccaatgttcgcctgtcacgccagttcctgaaattaaaggctggcgagtcgtaagtcgtgtacaggtaaaaagtaaccctcagcgtctgttaaggcgttcagtgaaaaaaggctggctaactgaagaacaggcgattgaacgactggcgacgcaggctgaacagcggaccgatttaccctttcttaatatgaagagtttgtcgagtcagcaacagttcaagttgtttatccgtcatggtgatttgctcaaagaaccggttaaaggggaatttagtagttatggattaagcgcaaccgccactattccctggttttgatgctttgcaatttttaacaggcctggccatgtgattgggcctttttatgcgcgccatgcccaccgcatacaaaaaaagcccgtactttcgtacgagctcttctttaaagatggcggtgaggcggggattcgaaccccggatacgttgccgtatacacactttccaggcgtgctccttcagccactcggacacctcaccaaattgttttgctgccagacctcataggtggcaacggggcgctactatagggagttggagtaaaacggtcaagaagaatttatatagattgattcgtttggttacgcaatgaacacactgttggtgggacggagattatgactgtatgtgttctggtcaattgtttatcaaaagctatgcagaaaatatgagattgaagaaataccaaatcgtccctttttttagggcgaaatgtaactcattgattttgtttactgctattttgaagtctggaaaaagggggtgaatctgcgattttgtaagttttaacagtaaatcaatcggatagtctgctattattccagttcactgccgtacaggcagcttagaaatgcaaacgctacttgctcattgaccacgtaaggttcactgccgtacaggcagcttagaaaggttaggggtatcggcgcgcttgacctcctgaggttcactgccgtacaggcagcttagaaattttggggatacctgtgtaaaccttgaattctgttcactgccgtacaggcagcttagaaattgttgcgtgttgtcgcatccaggatgcgacagttcactgccgtacaggcagcttagaaatgtcagggcaggccccgacacccagaacgtgcgttcactgccgtacaggcagcttagaaattcagcagctctcgaacacgttcccaacctttgttcactgccgtacaggcagcttagaaaatgcggttggtaggtggtcgtagaccgtcagtgttcactgccgtacaggcagcttagaaagttccgtataccagtgatatgcagaaggaacagttcactgccgtacaggcagcttagaaaaggagcattggcggagggaacgcgagcgcgggtgttcactgccgtacaggcagcttagaaagaatctcggcgcgacggcacccgccaccggggggtcactgccgtacaggcagcttagaaaagttcgcggcagacatacacgccgggagttttgttcactgccgtacaggcagcttagaaacagcggggtgattgaatattttggcatcagacgttcactgccgtacaggcagcttagaaatttctgctgttatcgccgggttgcacgagtgcgttcactgccgtacaggcagtcttcaaactcaacactccatcctctaatatttattccccataactcatagacgcaaaaaaggccggttaaaccgaccttttactcattctttctcttcgcccatcaggcggtaaaacaatcagcgactacggaagacaatgcggcctttgctcaggtcgtacggggtcagttcaacagtcactttgtcgcccgtcaggatgcggatgtagtttttgcgcattttaccggagatgtgtgcagtaaccacgtgaccgttttctaactctacgcggaacatggtattaggcaacgtttcaagaacggtaccttgcatttcaatattgtcttctttggccatctaatcctctggggtatcactaccgtaatttgaaccggcaagataatgccgaagttctgtaaataagtaaagatttgcgcgctaaatcgcaacaaacaggttcggcacattactccgaaaacacacggctaagccgcaccaaaagcgcaacgtataagggagcggtgagataaacgatgggcgttacctgacgcgaaaaattccttatcggcagcggggtaatgagcgtaaccaactctgcgaccgcaattataacactctggggagaaatgtgccgaaaacattcattcttgtggtgaaaacaagcatcgaggtacccagaaattattcggcaatcgtccgaggcgcatttgattgagataattaaggtaatcccggcggggaatttcgcaggcaccaagcgatgctgtgtgatcgttaaggacctggcagtcgataagtttaccgccatgacggataaattcatcacagaagaccagaagcgccgttttggacgcattttccatccggctgaacatggactcgccacaaaatagtgttccctgggccacgccgtacataccgccgacaagctcatcttcacgccagacttcaatggagtgggcatgaccgagttcgtgaaggcgatggtaggctttgaccacgccacgcgtgatccaggttccttcttcgcgatcgctggcacagccttcgatgacctgaccaaaagcgtaattcatcgtgacacgatagggtgagcgtttatgaaatcgcttcatactacggctgatatgcagtgattctggccataacaccgcgcggggatcgggcgaccaccagaggatggggtcgccaggagaaaaccacgggaaaataccacgctgataagccattaaaaggcgcgcagggctaagatcgccccccagtgccagcaggccgttaggctcacgtaatgcgccttccggggaagggaaggctattgaatggcgagaaagctgaaccaggcgcatgaccgcaaaactccacgcaagtcggatcgttcaataatagcttacaaaccctgcttaaactggtaataacgcccctgtctggcaagcagttctgcgtgagtaccttgctcaataatttgcccgttgtccatcactattatttgttggaaacgagagagtccgcgaagtcgatgggtgaccattaacaccgttttctcgcacatcatttctgcaagcaattcaaggatctgactttcggttgtggcatctaagccttctgtaggttcatccagcaataccagcggcgcatcatgtaacagcgcacgggcgatagccagacggcgcagttcaccaccggagagctggcgtccgccttcacctaaccaactgttgagacctgcatcctcgagcagcttctccagaccaacgcgacgcaagatctccgccagagcctcatcactactaccaggcgaggcgagtaacagattatcacgcagcgtggcgctaaacagatgcactcgctggggaacaacgctgatggtctgtcgtagagccgcttcattcaggctggctatgggactatcgttaagcaaaatctcgccctgttgcgggtccaatgcgcgggtcagcagttgtaacagtgttgatttgccgcatccggttcgcccgagaatcgcaatatgttccccggcgtttacctgaagataaatccctttaagtgcctgttgggattgctccggataagtgaactgaacatcccgtaatgtcagcgaaacgcgatcggcaacacgagtttgggtatcagggaaggtgacttccggtttttgatccgttaaatcagtgatccgtacggcagaggcaatgacttgccccagatgctgaaatgcacccgttactggtgccagcgcttcaaacgcggctaacgcgcagaagacaaacagggcaattaacgcgccgggttgagcattgccgccaacgccgccggacgccatccacagcatcaggatcaccgctaacgcgccaatgagcagcattatcgcttgcgacaatgcggtcagttcagattgacggcgttgcgcttccagccactgaatttctgtattctctaattgcgtgcgataacgatcgctggcaccaaaaatggtcagctcagcttgcccttgcagccaggccgtcagttgttggcgatactgcccgcgaagatgagtcagattttgcccggtgctttttcccgcacgataaaacagcggtggcatcaggaaaagcgtcagtaacataatgccgcccagcgtaaaggcgagggtgaaatcaaggaaacttaacccgattgtcaccaccataatcaccacaaaagcacctaccagcggcgagataacgcgcaggtaaagatgatcgagcgtatcaacatccgccaccacgcggttgagtaattcgccctgacgatagcgcgccagtccggcaggggagaggggcagcaatttgctgaaggtgtatatgcgtagatgctgcaacacgcggaaagtcgcgtcgtgacttaccagacgttcaaaataacgcccggcagtacgggtgattgctgcgccacgcacgcccgcagcgggtagcatatagttgaagctgtacagtccggcaacccccgcaaccgctgaggcggagaggaaccagcccgaaagtgtcaacagaccgatactggcgagcagcgtgacaattgccagcacgataccaagacttaacatccatttatgacgtttatacagtgccagatagggtagcaaagcgcgcatttaaatctcctcctgacgatgggccagtaatgtggcgaatgggccgccagccacacttaattccgcgtaacgtccttgctcaataatctgaccatcctgcattacccaaatgacatcccagtcagcaagatcttctaactggtgggtgaccattaacgttgtctggcgcagagaggcggcattcagcgcctccattacgcgctgttcactgtgagcatcaaggctggcagcgggttcatccaacagtaatagcgaacagggatttagtaacgcacgggccaccgccacgcgctgcgcctgccccacggaaaggcgggcagcctggtcgccaacaggcgtatcaaccccttgcggcaggagcggtagaaactcactgacccaggcgttatccagcgctgtttgtaactcttgttcgctggcatcaggtcgcgccagtagtacgttatcccgtaatgttgctgccggtaattgtgggttttgcccaacccaggagagatgtttacgccatgattccggtgataaatcgcgtaattctatcccgttgattcgtagcgatccctgatatgagagaaaaccagaaagcgcgttcagcagtgaacttttacctgaaccgctgcgaccaaccaacactgctcgttggcctgctggcaaagtaaaattcagcggtccggccagcgttttaccttccggcgacgtgataaacagatcctcggcttcaatggtcaccggatcggtcgatgctaattccgcctcaccgcgctgcggatgggcgagcggggtttccataaacgttttcaaactgtcagctgcaccaacagcctgggctttagcatgataaaacgtaccgagatcgcgtaatggctggaaaaactctggcgcaaggatcagggccagaaaacccgcagccagcgtcacgccagtatcgtagtgaccaaaatccagctcgccgaggtaggaaaaaccaaagtagaccgccaccagagcaatcgacagcgaggtaaaaaattcgagaatgccggaggataaaaacgccagccgtagcacttccattgtccgttggcggaaatcttccgaagcagaacgaatactttcaatttcagcttcaccacgaccaaaaatacgcaatgtttccatgccgcgcaggcgatcgaggaaatgcccacttaagcgagcaagagcgagaaagttacgtcggttagcatcggcagcccccattccaaccagcgccataaataacggaattagcggtgcagtgcccagcagaatgagcgccgcggcccagttagaggggaagatagccaccacaatcagcagcggcaccgacactgccagcgccatttgcggcaggtagcgtgcatagtaatcatgcatatcgtcaatttgctcgagtaccagcgtcgcccagctccccgctggtttaccctgaatccacgctggccctgcttgttgcagacggtcgagaacctgacggcggatggcaaagcggatatgctgcccggcgtgataacccacccgttcgcgtaaccagaccacccatgcgcgcagtacaaaggtcagaaacagtaacgtaaagggaagcagcagggcttcacggggaatattctccataatcatatgttgcagaattcgcgccatgaaccaggcctgggcaatgatcaatatgccgctcacaaagcccagcagacgagaaatattcagccaacgttgggagatgacgctttgctgttttaaccagcgggttaattctttttgacgggatttattcattgcacgcttagcaggtgagttatcagaattatttgcagagcaatgttacaacggggaaaaaataaaggcgacccatagtcgcatggtgtcgccttctttacttttgttactgatttgtaaaattattttgcgtcagctaaaccgtcgaggtagcgttccgcatcaagagctgccatgcagcctgtaccagcagatgtaatggcctggcgataaatgtgatccatcacgtcgcctgcggcaaagacgccagggatgctggtctgggtggcattaccatgaatacccgactgtactttgatgtagccgttttccagttccagctgcccttcgaaaatggcagtattcgggctgtgaccgatagcaacaaacagaccggcaacgtcgagtgactcgatgttatcgctgttttgcgtatcgcgcagacgaacgccagtgacacccatctgatcgccggtcacttcttccagcgtacggttggtgtgcagaataatgttgccgttctccactttatccatcagacgcttaatgaggattttttccgcacggaaaccatctcggcggtgaatcagatgaacttccgaagcgatgttagacagatacagcgcctcttcaaccgcggtattgccgccgccgatgaccgcaactttctggttgcgatagaagaaaccgtcgcaggttgcacaagcagaaactccacggcctttaaaggcttcttcagagggcaggccgagatagcgtgcagaagctccggtggcaataatcagcgcgtcgcaagtgtattcgccgctatcgccagtcagacggaacggacgattctgcaaatcaactttgttgatgtgatcaaagatgatttcagtttcaaatttggtggcatgttcgtgcatgcgctccattaataacggaccggtcagatcgtttggatcgccaggccagttttccacttccgtggtggtggtcagttggccgcctttttccatgccggtaatcagcacaggttgcaggttggcgcgcgccgcgtagacagcagcggtgtatcccgctgggcctgaacccaggataagcagtttactgtgtttggtcgtgcccatgagatccccatagttgttggcagacaatggcaggattgtagggaatttacagacgtaaaaaaagagtatgacgattttgttaacaatttgtgcaatcggcagcatcgataagcaggtcaaattctcccgtcattatcacctctgctacttaaatttcccgctttataagccgattaaatgatgaataaacgcccctgttaatgaatatctggcatgttgtactaaaaatcgatgttttgctttgacaatcccctagtgttttgcgaaaacattcgaggaagaaaaaaaacagtattcttatatgcgcataaccatgcatgtaaataccatgtttaccgtgctagtgaaatctacgtatggcgtggacagacgccattcgtgatgtcgatagctgccacaaggcaacggtcttctcaccgtagacccaggcattgcgcgccgtgaatcttcatgatttcggtctatcgtgacgggtagcgactctgaacagtgatgtttcagggtcagacaggagtagggaaggaatacagagagacaataataatggtagatagcaagaagcgccctggcaaagatctcgaccgtatcgatcgtaacattcttaatgagttgcaaaaggatgggcgtatttctaacgtcgagctttctaaacgtgtgggactttccccaacgccgtgccttgagcgtgtgcgtcggctggaaagacaagggtttattcagggctatacggcgctgctgaacccccattatctggatgcatcacttctggtattcgttgagattactctgaatcgtggcgcaccggatgtgtttgaacaattcaataccgctgtacaaaaacttgaagaaattcaggagtgtcatttagtatccggtgatttcgactacctgttgaaaacacgcgtgccggatatgtctgcttaccgtaagttactgggggaaaccctgctgcgtctgcctggcgtcaatgacacacggacatacgttgttatggaagaagtcaagcagagtaatcgtctggttattaagacgcgctaacacggaacaggtgcaaaatcggcgtattttgattacactcctgttaatccatacagcaacagtactggggtaacctggtactgttgtccgttttagcatcgggcaggaaaagcctgtaacctggagagcctttcttgagccaggaatacactgaagacaaagaagtcacattgacaaagttaagtagcggccgccgtcttctggaggcgttgctgatccttattgtcctgtttgccgtctggttgatggctgccttactaagctttaacccttcggaccccagctggtcgcaaacggcctggcatgaacctatccataatttaggtgggatgcccggtgcgtggttggcagatacgctgttctttatttttggcgtgatggcttacaccattcccgtcattattgtcggcggttgttggtttgcctggcgtcatcagtccagcgacgaatacattgattattttgccgtttcgctacgcatcattggcgttttggcgctcatccttacctcctgtggtctggcggcaatcaacgctgacgatatctggtattttgcctccggtggcgtcattggcagcttactaagcactacgctacaaccactgctacacagtagcgggggaactattgcgctgctctgcgtttgggcagcgggcctgacgctgttcaccggttggtcatgggtgaccattgctgaaaaactcggcggctggattttaaatattcttaccttcgccagtaatcgtacccgtcgcgatgatacctgggtcgatgaagatgagtatgaagacgacgaagagtatgaagatgaaaatcacggcaaacagcatgaatcacgccgtgcccgtattcttcgcggcgcgctagcgcgtcgtaaacggttggcggaaaaattcattaatccgatggggcggcaaacagatgctgcgctgttctccggtaagcggatggatgatgaagaagagattacctacactgcacgcggtgtggctgctgaccctgacgacgtcctgttttcgggcaatcgtgcaacgcagccagaatatgacgaatacgatccattattaaacggtgcgccaattaccgaacctgttgctgtagcagctgctgctaccacggcgacacaaagctgggctgcaccggttgaacctgtgactcagacgccgccagttgcctctgttgatgttccacctacgcaacctacagtagcctggcagcctgtaccggggccgcaaacgggagaaccggttattgcacctgcaccggaaggttacccacaccagtcacaatatgcgcagcctgcagtgcaatataatgagccgctgcaacaacctgtacagccacagcagccgtattatgcgcctgcggctgaacaacctgtgcaacaaccttactacgctcctgcggcggaacaacctgttcagcaaccgtattacgcccctgcgccagaacaaccggtggcaggtaacgcctggcaagccgaagagcagcaatccacttttgctccacagtctacataccagacggagcaaacttatcagcagccagctgctcaggagccgttgtaccaacagccgcaacccgttgaacagcagcctgttgtggagcctgaacccgttgtagaagagacaaaacccacgcgtccgccgctttactattttgaagaagtggaagagaagcgagcccgtgaacgtgaacaacttgcggcctggtatcaaccgattccagaaccggttaaagaaccggaaccgatcaaatcttcgctgaaagcaccttctgttgcagcagtacctccagtagaagccgctgccgctgtttctccgctggcatctggtgtgaaaaaagcgacactggcgacgggggctgccgcaaccgttgccgcgccagtcttcagtctggcaaatagcggtggaccgcgtccgcaggtcaaagaggggattggcccgcagttgccacgaccgaaacgcatccgcgtgccaactcgtcgtgaactggcgtcttacggtattaagctgccctcacagcgtgcggcagaagaaaaagcccgcgaagcccagcgtaatcagtacgattctggcgatcagtacaacgatgatgaaatcgatgcgatgcagcaggatgaactggcacgtcagttcgcccagacgcagcagcaacgctatggcgaacagtatcaacatgatgtgcccgtgaacacagaagatgcagatgctgcggcagaggcagaactggctcgtcagtttgctcaaactcaacaacaacgttattccggcgaacaaccggctggggcgaatccgttctcgctggatgattttgaattttcgccaatgaaagcgttgctggatgatggtccacacgaaccgctgtttacgccaattgttgaacctgtacagcagccgcaacaaccggtagcaccgcagcagcaatatcagcagccgcaacaaccggtagcaccgcagccgcagtatcagcagccgcaacaaccggttgcaccgcagccgcagtatcagcagccgcaacaaccagttgcgccacagccgcaatatcaacagccgcaacaaccggttgcaccgcagcagcaatatcagcagccacaacagccggttacacagcagccgcagtatcagcagccgcaacagccggttgtaccacagccgcaggataccctgcttcatccgctgttgatgcgtaatggcgacagccgtccgttgcataaaccgacgacgccactgccttctctggatttgctgacaccgccgccgagcgaagtggagccggtagatacctttgcgcttgaacaaatggcgcgcctggtagaagcgcgtctggctgatttccgtattaaagccgatgttgtcaattactctccggggccagttatcactcgctttgaattgaacctggcaccgggcgtaaaagcagcgcgcatttctaacttgtcacgtgaccttgcccgttcactttcgacggtggcggtgcgtgtcgttgaagttattcctggcaaaccctatgtaggtctggagttaccgaataaaaaacgacaaaccgtttatctgcgcgaagttttggataacgccaaattccgcgataatccgtcgccattaaccgtggtgctgggtaaagatatcgccggtgagccggtggttgccgatctggcgaaaatgccgcacttgttggttgcggggactaccggttccggtaagtctgtcggggtgaatgcgatgatcctgagcatgctttataaagcacagccagaagatgtacgtttcatcatgatcgacccgaaaatgctggagctttcggtttatgaaggcattccgcacctgttaacggaagttgttactgatatgaaagatgccgccaacgcgctgcgctggtgtgttaacgagatggagcgtcgttataaactgatgtctgcgctgggtgtgcgtaatctggcgggttataacgaaaaaattgctgaagccgatcgcatgatgcgtccgattccagacccgtactggaagccgggtgatagtatggatgcgcagcatccggtgctgaaaaaagaaccatacattgtggtgttggtggacgaatttgccgacctgatgatgacggtaggtaaaaaagtggaagagctgatagcacgtctggcgcaaaaagcccgtgccgcgggtatccacctcgtactggcaacgcagcgtccatcggttgatgttattactggtctgattaaagcgaatattccgacccgtatcgcctttaccgtatccagtaagattgactcacgtaccattcttgatcaggctggtgcggaatcactgctgggtatgggggatatgctctactctgggccgaactccacgttgccggtacgtgtccatggtgcttttgttcgcgatcaggaagttcatgccgtggtgcaggactggaaagcgcgtggtcgcccacagtatgttgatggcatcacctccgacagtgaaagcgaaggtggcgtgggcggtttcgatggcgctgaagaactggatccgttgttcgatcaggcggtgcagtttgtcactgaaaaacgcaaagcgtcaatttctggcgtacagcgtcagttccgcattggttataaccgtgcagcgcgtattatcgaacagatggaagcgcaggggattgtcagcgaacaggggcacaacggtaatcgtgaagtgctggccccaccgccatttgactaattaatgcaacgtagaccggataagacgcgatagcgtcgcatccggtattctatcaactgaaaattcagtattttcttctttcctcaagctgattattagcctggaatagagagtagagggaactcccgattgggagtgacgtaatttgaggaataatgatgaaaaaaattgccatcacctgtgcattactctcaagcttagtagcaagcagcgtttgggctgatgccgcaagcgatcttaaaagccgcctggataaagtcagcagcttccacgccagcttcacacagaaagtgactgacggtagcggcgcggcggtgcaggaaggtcagggcgatctgtgggtgaaacgtccaaacttattcaactggcatatgactcaacctgatgaaagcattctggtttctgacggtaaaacactgtggttctataacccgttcgttgagcaagctacggcaacctggctgaaagatgccaccggtaatacgccgtttatgctgattgcccgcaaccagtccagcgactggcagcagtacaatatcaaacagaatggcgatgactttgttctgacgccgaaagccagcaatggcaatctgaagcagttcaccattaacgtgggacgtgatggcacaatccatcagtttagcgcggtggagcaggacgatcagcgcagcagttatcagctgaaatcccagcaaaatggggctgtggatgcagcgaaatttaccttcaccccgccgcaaggcgtcacggtagatgatcaacgtaagtagaggcacctgagtgagcaatctgtcgctcgatttttcggataatacttttcaacctctggccgcgcgtatgcggccagaaaatttagcacagtatatcggccagcaacatttgctggctgcggggaagccgttgccgcgcgctatcgaagccgggcatctgcattctatgatcctctgggggccgccgggtaccggcaaaacaaccctcgctgaagtgattgcccgctatgcgaacgctgatgtggaacgtatttctgccgtcacctctggtgtgaaagagattcgcgaggcgatcgagcgcgctcggcaaaaccgcaatgcaggtcgccgcactattctttttgttgacgaagttcaccgtttcaacaaaagccagcaggatgcatttctgccacatattgaagacggcaccatcacttttattggcgcaaccactgaaaacccgtcgtttgagcttaattcggcactgctttcccgtgcccgtgtctatctgttgaaatccctgagtacagaggatattgagcaagtactaactcaggcgatggaagacaaaacccgtggctatggtggtcaggatattgttctgccagatgaaacacgacgcgccattgctgaactggtgaatggcgacgcgcgccgggcgttaaatacgctggaaatgatggcggatatggccgaagtcgatgatagcggtaagcgggtcctgaagcctgaattactgaccgaaatcgccggtgaacgtagcgcccgctttgataacaaaggcgatcgcttttacgatctgatttccgcactgcataagtcggtacgtggtagcgcacccgatgcggcgctctactggtatgcgcgaattattaccgccggtggcgatccgttatatgtcgcgcgtcgttgcctggcaattgcttccgaagatgtcggcaatgccgacccacgggcgatgcaggtggcaattgcggcctgggattgctttactcgcgttggcccggcggaaggtgaacgcgccattgctcaggcgattgtttacctggcctgtgcgccaaaaagcaacgctgtctacactgcgtttaaagccgcgctggccgatgctcgcgaacgtccggattatgacgtgccggttcatttgcgtaatgcgccgacgaaattaatgaaggaaatgggctacgggcaggaatatcgttacgctcatgatgaagcaaacgcttatgctgccggtgaggtttacttcccgccggaaatagcacaaacacgctattatttcccgacaaacaggggccttgaaggcaagattggcgaaaagctcgcctggctggctgaacaggatcaaaatagccccataaaacgctaccgttaatgttatcgttgcggtaatgttgttaatgtatccctgtggtcgcaggctgtggccacatctcccatttaattcgataagcacaggataagcatgctcgatcccaatctgctgcgtaatgagccagacgcagtcgctgaaaaactggcacgccggggctttaagctggatgtagataagctgggcgctcttgaggagcgtcgtaaagtattgcaggtcaaaacggaaaacctgcaagcggagcgtaactcccgatcgaaatccattggccaggcgaaagcgcgcggggaagatatcgagcctttacgtctggaagtgaacaaactgggcgaagagctggatgcagcaaaagccgagctggatgctttacaggctgaaattcgcgatatcgcgctaaccatccctaacctgcctgcagatgaagtgccggtaggtaaagacgaaaatgacaacgttgaagtcagtcgctggggcaccccgcgtgagtttgactttgaagttcgtgaccatgtgacgctgggtgaaatgcactctggcctcgactttgcagccgcagttaagttgactggttcccgctttgtggtaatgaaagggcagattgctcgcatgcaccgcgcactgtcgcagtttatgctggatctgcataccgaacagcatggctacagtgagaactatgttccgtacctggttaaccaggacacgctgtacggtacgggtcagctgccgaaatttgctggcgatctgttccatactcgtccgctggaagaagaagcagacaccagtaactatgcgctgatcccaacggcagaagttccgctgaccaacctggtacgcggtgaaatcatcgatgaagatgatctgccaattaagatgaccgcccacaccccatgtttccgttctgaagctggttcatatggtcgtgacactcgtggtctgatccgtatgcaccagttcgacaaagttgaaatggtgcagatcgtgcgcccggaagactcaatggcggcgctggaagagatgaccggtcatgcggaaaaagtcctgcagctgctgggcctgccgtaccgtaaaatcatcctttgtaccggcgacatgggctttggcgcttgcaaaacttacgacctggaagtatggatcccggcacagaacacctaccgcgagatctcttcctgctccaacgtttgggatttccaggcacgtcgtatgcaggcacgttgccgtagcaagtcggacaagaaaacccgtctggttcataccctgaacggttctggtcttgctgttggtcgtacgctggttgcagtaatggaaaactatcagcaggctgatggtcgtattgaagtaccagaagttctgcgtccgtatatgaacggactggaatatattggctaatacccaatttttctgaatctaaaaagcgcctgcgggcgcttttcgcatgaggttaattaactgaaaataaaagggatttattttcaggtgtccatataatgcccatctttgaaacaaaaaaagcccgcagtttttacgctgcgggctttatttttctttgtgacttgcgtgtgagggtgctactttcggccttaccctgacaaccgattgacgggggattactcccccgtcgcggtttccttactgcttacactgtaagaacgccgcaaactccgctccccagatgttcatccgtatttcacacagcgaaccatgtaacatccagatgatgaggattgccgtcacgcagaacgtgatggccataagcgatttttgcgacatagcgcttgctcctttgttggagaggcgctaacctgtcacttgctaaggttagatggttagggcctcgggttaacgtttaagttgactcggggcctttccacatccggccttcaggtaatccttccagccgtcagccgaaaggcacccacgtgtaatctactgatttccctttgtgcgcgcaatgctcagtgttgaaactgtttagggggagggcggcaaaaaagcccgcatattgcgggcaaatacgtctgtaatccaatggagaaaggggtgccatatcgactgcacccgacaaccggatagcgggggctttcacccccgctgcggtttcttactgtttacactgcaagaacgccgcaaattctgaccacatgatgttaagtctgaactcacacggcgaacggtgtatcatccagatggccaacaacatggttaagcataaaatgctcacgatgatcgttttttgcggcatagcgcttgactccttttacagggaggcgctaaccttccacttgtctagggtaggaatggttagggcctcgggttaaacaatatgtttgactcggggcctttccacatccggccttcaggttttccttccagccgtcagccgaaaggcacccgcgcgtaatgtactggttttgaggatatgccgcaatcctccagttgtagcgttaactgactgcgtccctgatgggatttgcgcattgtctcccgtggaatatctttatcatggaagagcaactgaggctggccaataattctgtgcacactttccattgttgaaaatgtggcgctgcactcaaggttattgcactgatagtatttgtagcggatggtgccggtatcattggcggctttactggtacggatccgggcagatgcgccgcagaatggacaatgaaacattgatatacccccctggctgaactggggttgaactcgtcgccattctaaccattgctttccttttcagctatccactcgggtattcttgcctccagttcaagccttgtggtgaagccgcttccgtcgatattgtgttccacttttgcaatgagccagtcctgattgtctatctcggttttaaagccggttaccgtgccatgcatttccgggtaaagctccgctctgccccgggccagcgtgatggagaattcagccgcaccgcgctgtaattgctgccacctggcggcagctgcgcgctgtgcagcaatttcatttgggtaggtttttctcagaacgaacacgttaccttctgccccctccatgtagctgccttcccggctgctgctcttttcagcgtgagtttttcgtttttttatgttgacggctttctttttgccatgattcaaatccagccagtacgccttcacccctgtgtatgcctggcgatcggctattctgaactggtgactgtctccgtcactgcgtgccagtgcaaatgaggggagtgggcgcccgtcagctgtcacgccgccacccggcagaatgaacagcagacagccatttttgacggtagtgatggctcccagcatatcagccatgcgggtaaggaatgacatgtcgctttcttccgtctggtcggcatgatcgatttcaatatccataagcatatcgcttatctgggctttcagtccgtaacggtgggcaatagcggaaaccacgcgttcaacagtcacgccgtgccaggatacttcccgtttgacgttaaattcctccctgaagtctgcgctgtttgcactcagtgtcagccgatccggaggtccttcatgagcgacctcatcaacaatgtaggtgcctttatcaaccagaggctctcccttccatcccagcatgactctgatgtgtgttccccgcccggggagagccagctgcccgtcggcatcatccagcacaagagtgaccctgtctgcttcaaacccccggttgtctgtcatggaaagcgatatcacccggttattcagttcctgaagagtgtttttatcctgctccctgtccagtgaaacgctgaaatcaggcattttcaccagttctttcaggggggaataaaccgtgttaccgttcagcaataccataattcctccgtttttcccgccacagttgcataccagaaacaccaccggaatgagtttgggttgtatgtgtattgcgagaaaccgcagttcgtgaaaaagctccccgtgttcgtaaagatctctgctgaactcacacgaatgcagggtgaataatatggctgaaacccgtttccatggcgtgcgggtccgggagaatgcggatctggtcacggccattaatgatattgactccagtgtgattggtatcgtggctgttgctgatgatgctgatgcaaaaacatttccgctggataagccggtgctcctgacgcgcgttatggatgtgctgggtaaggccgggaaaaccggcacgctgtacaaaagtctgaaagctattgccgatcaggtcagcaccagagttgttgtggtgcgggttgctgctgcgaaggagggggatggtcagccgacacaaacgcagcttgttattggtgaggtcaaaaatgacggaacctatacaggcatgcaggcgctcctggtggctgaacagaatgaggctgttggtgttcgtcccaggatcctggccgtgccatcgcttgacaccaaagaggtggtggcggcactggtaaccgtcgcgaaaaagctgcgtgcctttgtgtatgcgggctgtcccggctgtaataccgtgcaggaggctgttacctggcgcgccgatcttgctcaccgtgaagttatgctgatctggcctgattttatcgcgtacaaccctaacagtggccagaatgaggcttttcctgcatctgcgtatgcgtgcgggttgcgtgcgaagattgaccacgagcagggctggcataaatccctgtccaatgtggcagtgaataatgtcctgggtatttctgtgccggtgttctggtcgctccaggcagaggacagtgacgcggaaaccctcaatgacaaggagatcaccacactcattaaacgtaacggcttccgtttctggggtaaccggactctcgacaccactacctacacctttgagacctacacgcgtacggcgcagtcgctggcggataccatcgccgaatcgcagtttgaaaccgtggacaagccgctgacgccgtcgaacgtgaaggatgtgttaagcgatatccgggcaaaactgagtgcccttgtgacagcgggtaaacttatcggggcagagtgctggtatgacgtggtggataacggcacaacggatctgcgtcaggggattgtgcggatccgctacagatatacgccggtaccaccgcttgaagatctggagcttcaccagacgtttactgatgagttctttgacggtgcatttgcatcactgggaggtgagtaatggcggtaccaaacaaacttcgcgttttcacggtgtacatcgatggcgaaaacaagctggggcgggtgacgtccttcacgccgcctaaactgacccgaaaaacggagtccttccgtggtgccgggatgcccggcagtgtttccgtcgactttggtcttgatgatggtgcactggatctctcttttgcggtaggcggcgcagatgcccaccttttctcccgttatgccgggtcacttgatgaagtccgtcttcgcttttccggtgagtactattcggatgcggatatcagatatgtggatattgaggtccgcgggcgcatcactgaaatcgatatgggggaggcgaagcagggtgaagacactgagcacagttattcgatgaaaaacacctggtacagactgagtgtggacgatctggaaaaaatcgaatttgatgtgctgaattttatctggcgcattgacggtaaggatgtgctgccggatcgcacccgctcgatgctgggcttctgatgatggtttaacagagaacggcggggatcccgccgtggagactgaaaatggataaagaaacggaaatggccactggcactgccgtcagtaacggggaggcttccgcggtggcagttgccgctacggctgcacctaagaacgtggtgaagctgacggtgcctgttgtgcgcggagatgtgtcgtacagtgaaattaaaatcggaccgctggcgaatcaggccggatcgctgcgtgggctgtctttgcttgcgctttacaacatgaactgtgatgccatggtcacctggcttgcgcgtgtgacagagccaaaactcaaggaggccgaaatgtatgccatgaatacggcggattttacggcgctgagctcggcggcggttaattttttcgcaccctcggggtcgaatgcaccggcaccggagaacacggcagagccgtaacctgtctttgctttgactgcattgaagatcccgttgcggatattgctgttatttttaactggccgcccgcagagatatttgcaatgacgcctgcagaggtggtcgcctggcgtgagcgggcggctgccagaagcggaagtcacaatcatgatgaataatctgcatatcagggttgctctggcggcggcagacaccctgacacaacctctcaggcgcgcccgcgaaaccgtgggcgcgctttctgattccctccgtgaaactcaggactccatccgctcgcttgaacggcagagtgaagcctttgctgcggcacagactaaatttgacgaagccacccggaaaattgccgctgttcagcagcaactgaaccgtctgcagcaggcggagcgtgagggtaccgtgctcagtgaacggcagcgtgaaatgatggcttcgctgaccacccggcttgaacgtctgaaccgggtgagggatgtacatcagcgacgcctggaggattctcgccgggagctggagagacacggtattgccgcagagggcagcagtcagaccatacaggcagccattcgccggacggcagagtataacgaagcgctggcgcgacagcggcaggcactcgcacaggtgacccgtgcacagcaacgctatgaacaggcgcaggagcgactcgggcggatacgtaatgccggtgcggcggcactggctgccggtgcagcaggactttacgctggcgggcgtgccgttgcgccggtgatggatctccagcgtcatggtgccgtcattgcggctcaggcaggagagggcgcgtcagatgccgtggggtataccggggttataaaccacatggttcataccggtatcacaccggatgcacaactggcggctgaagctgtgggtgctgtccgctccacgctgggtgggctgggggcggttagtgagaatgaactgacccgaatcacccgaaaaatgctggatatgcaggccgtgatggggggcgatatcccgcagcacattcaggcggctgccatcatgatcaaaaacggtcttgcacgcagcagtgacgaggcggttgatctgatggtggcgggcatgcagcgcatggggccggttatgcgcgatgagctgcctgagatccttcacgaatattcgacccattttcgtaacatggggctgacagggtcggaaaccatgacgctccttgcggatatggcgcagcaggggaagtttgcgctggataaaaccggcgatgccatcaaggagttcagtattcgcggctccgatatgtcaaaggcgagtgctgaagcgtatgcgcttatcgggctggatgcagccaggatgtcatcggctgtagccagtggtggaacggctgcacgggctgcgctgcagaaaacagcctcgggtctgttgcagatcgtcgatccggctgagcgggccaatgcggccatcgcactttttggtacaccggttgaagatctgtctgtcgatcaaatccctgcctttcttggcgcgctggcgcgggtgtctgaccgtatggctgacgtgtctggtgtggcggaccggatggggcaaaccctgcgtgacaatctgagtggtgatgtggcgcggcttaccgggacgttcagcgcgctgagaagtgggattatcggggagattacggacgatctgcgtgggcttgtccggatggccacagcgtggggtgagcgtctgcaggcgtgggtgaatgcgcatccggaactggtgcgaatgattgcgctgacgacgggagcggtgctggcgttaaccacagcgatgggggcgttgtccgttgcggcctggatggttgtcgcaccgttactgaaactgcgtctggggcttgccctgcttcgcgcgatcccggccggactctccgttgccggtacgctgtttggcggactgacgggtgtgatttcagccgtgggggctgcgcttggggcgctgacctggccggttgtggtggcggtgggagccctggtcggtggtgctctgctggtctggcgctactgggatcgggtcagggcgtttgtgagcggatttattgaaggggtacagtcagcactggcgcccttcatggcgacagcctcccgttttgcgccgctgctggatctggtttcaggggcactgtcccgtattctgggatggtttaaatccctgttaacgccggtctcctccacgcgtgatttgcttgagcagtgcacctctgccgggcagatgttcgggagtactctggccggtgcgttagccacggttttttcgcccctgaaagctctgattgacggtctggcgtgggtgctggaaaaactcggtgttctgcccggtgaagctgagcgggttaagcgaaaactggatgaggcccgtaaaacgccggtggcgtgggagtgggatccggaacagaaaaaaatggttcagaaggcgtggcactggtcgcctcctggtggggccagtgtgccttccggcgcctccggtacacagcctccgccggtggcgctccctgcggggatagcgccggacggtaaccgtaacgttctccgtcacctgaaaggcattgaggggaataccggtggtctgctggctgaaaaccgtaaacgtatcggacccggagatattgtgtttaaacatcttccacgggcgctggcggtccgggggcagtggcatgaacctgtcgttgcgccgtcttccggcggaatgcgcgcgctgccacaggaggagattcaggtgcagcaatggccgacggcacgcccggcgccacgaatgcaccagcaggaaaccttcgccagcgcctttcagggggagatacatgtgcatcttcacggggtgagttcgcataatccccgggaactggcgcgcatggttggtgacgctgtcagggcggaaatgaacagaatggcacgtgccggaaccggcagcttccgcgatcgcgactgaggtgaaaaagatgatgatgatttatgggatgtttgtgtttcagttaagtaccctgccgcatcagcaggtggaacagagtaaacgctggcgacacgtcagtaatgaacgggttaaccgttcatcctcctggcagtatattggctctggtgaagatcacatcacgatgtccggtgtgctctgtccggaaatcaccggcggggaggtgtcactgactgccctgaacaccctggcctacacaggattaccctggccactgattgatggtgtcggacagatttacgggatgtatgtcattacggaaatcaggaccacccgtcaggagctggatcgctatggcatggcccgcaaaattgagttcactgtcagctttcagcgatgcaatgaagatctgcgtgagcgtcttcagtcgggctcggtgggtgatctgatggcaggattaaaaaacagcgcgtcgtcggccctgtcgtcggcgtcctctgcgctgtctggtctcatgttgtgaaggtcactgttcaggcttcggcttcttttccccagccaaccttatagtccagaatcgccgccgtatcgttcagggcggcgatctcttttttcatgttacgctggcgaatgtgaatttccatccctttggcaaacagggcttttgcggctgcatcgctgagggcaatcagctcatcagcagaaacaggaacatcgttgttctgtgcatcagtccagaaaaaatccagcggcaggatccccgcttttgcggcagcaacggaaggctcaaggcgggcctgcgttgacttcccgtagtcccatttccggccgttatgttcaaaggtgtaactcgccgcttccatcgcattacgccaggtgttgatttcgtcgtttttcaggcgtctggcgttttccctgtcagtgtcgttttcctggtattcagatacagggccgtgatttcctgctttcagttcgccccagagttttttgccgtgtggcgagttgtcatattcggttgccgtatagggcagccagctctcctccccttcaaactggatctcacagtcgatagtgccgtcacggttataagcggcatttcttgctgatttgattgtgtgcatgagtctctccgtcaggcaatgcgctcaaatattccgattcctgcgcctgcataaatgtcagcgcaggcccgccacgtgcccggtggcctgcggtttgtgttccagttttgcatggattcacgggggccgaagttgccttcggaatgagtcaggcttatcagtctgagtttactgcccgggcgggtgtttccggccgttatatcaattttggctggccactccccttcggcatccgttgccgccagaataaagctgcccacatcccagagtgtccgctgtgtttttgcctgtgcagcctccagtgcttgccgtgctttctgcccggcgttttctgctgccgtcatggccgtcttcacagcttttggtgtggcagccagcacttcactgtcactgtccgttgcgctgcttagctgaacaatacctcgctctgtcagggaggcatcgccggtctgcgtgatggggagtatggcaacctccttccattcagaccacggcccgttgccggtgaagttacctgtcactgtccggataaatttccgtggtggattccaggcggtgtattcctgctggcagaatccccatgcgcccatcctgatggataatgatccggctgatgttaccgggtagtgatgtgctgtagtggcgccgttgttgttgggctgatagtagtcaccatgatgttcaggtctccccagtgtattcagatccacggcgaggggggctgttggtcttgttactgtcagcgccttaagtgcttttattgctttgggtgtggctgcccgggtttcatcatcactgtcggtttcactactgagctgagtaaatcctttactggtggttgtggcatccgggtgtttaccgttttgttcatgctgctttatcatttctgccacgccagcctgtgttgccatggtggttgatgagtcggctgtcagatttacagaggcttcgttgctcagcagaatcaccatgcggaatacctgttctctgcctgagccctcatcaagctgcggtttgtaaccttccgcaacattacccacggcgatgagtgtgcctttgctgtcaaacagaccgatttcgcggatccagaatcctccttcattcgcaggaatgatcacttcggcggttaaaaaactggtgttttccgcgtcacggctgaccctgctgacctcgccccgccagacctctttaacgagagcggtttgcgtggccagtggttctgtgggtttaccgttaccgtctccgacggcgatatgtgtcagcgtgatcttttctccatccggtaacaccgcagctgcgagggctgctgtgccggcatttgtgataatggttttgtattttgcggccatcattactccttgtccggtctgatggttactgtgatgccttcataggtgactccacccgggtggatgtcaccactgactgacagcgggcttgtcacttctgctgccggatataccacgatggtttccccggtcagcgtggccccggttatgcgggatacaccccgtgcaacgtaggtcattttcatggcggcaaggtgtcggcttaccgggcgaacggtggtaatcattcgctccatctcctgccgggtttcctctgtcagtccgcgctccgatatgtcaatatccagcctgaatgaccccggcggatcgttgttctcccaccattctgtaatactcagtatcgcgccgaagggctccacagcccgacgcatggcgctgatggtgcctttgtggcggtgaatatgccacgagtcacggatgatctgacgacgtgcctcttcactccatgtttcatcccagcggtcaacggaaagcgcccaggcaagccatggcagcagatgggctgggcaggtgtcggggttccagagggtgttgatatggttcggcagctctgacaggcgctgagcgccctgttccgaatgatgcaggaaggagggcgatgatggcggcagcagtcggttattcatcggtgccacctgcagagatgttccgggatgtgcagcgggctgactgggtgttactgatcaccacattctgcgctggtttcttcagctcgactcgctgaacgcccggtacgtgtagcgttgccataatggcagagcgggccacatcacgccctatggcattctgagtcttcagccatgtgtcaagtgcatctctggcggcggcaagaatgggttcagattccgggccaggataaaaatagagtacggcctcaatatcgtaactgacgatggtcgcactctgtaccgtgagtctgtcggccagggggcgcacagtttcaccattgagagcccggctgacggtcgcgattaattccggtgacgctgtgccgtctccttccgttgagagaatggagacaatgaccgtcgcaggtgacggactggttgcccgtgcatcggcaacaagaccgctggcactgcgggcaaaatattcatatgcagcagaggggccggcgacgctgaaaccttcaaatccggattgtgcccgcagacggaacgcgctgtcgctctccatgatggcagcttctgtatcagtagcaggtttcagttcaaggcgtttcgcattcacgatagcggcgagattatccaggtctgtggatacggcatggctgagcatgcaccccgccgctgcatcgttgatccgctgacggagcagcatttcgcgaaaggcgatggcctgagcaatgatgttgagtggctctgattccagcgcaatggctgtgctgacggcactgcgcatgttctcagggaaggcatcaatcataaaggccttcacgtctttcagtatgctctcataatccagtgattcaatgatctgcggacgtggtaactgagacaggtcaattgtcggcattactccccctcagcggaatgctcatctgtacgggctgcattgtgcgggtgagcacgcctgagatggccagcagagcgcgtccgtcaggcagccaggtgatatccacccggttaatggcgatccggggctcccactgtgcgagcgccataaccaccgcgctcatgcactgcagacgtgtcacgtcgttttgtggcgcatcgagcagttcaggcaacaggctgccatactctcttcgcatgatgcgactgccgcgcggggtggtcagaatattgtttacagagtggcggaggtgttctgtgtcactgatgcatccgctaccatgcgggttcatgcctgtgcataccggtgtcatttcggcccccctgtcatgcttccgccggactgaacaccgttatgaacgtgcgtatgcacggtaacaccatttgagcgtaagtttccgttactgtgtgtgatatcccctttcatggtgccaccgtcagtcagttcaaacgtcctggccttcagatgttttgtgcactctacggccggtgtgtccagggtaatacgtgtttccgcagagatctctgcggttttgattcctttcaccgtcagcgcgcctttttctgcgtcatagcgtatctcggcaccgtcaggtgcaaggagtatcacttcattctgttttgtgccgggcgccgggtgttcttcgctgtagagactgccagccacaacggccatttcaggactgccgcccgggcagagcaacagcacctgttcaccgggggaggggggcagccagattttaaacgccccggcgcgtgtgcagttccagcggagccagtccgttgtcagtccgccgctggtagcgcgaatgcgccagtttttcagatccacctccgaaacgacgccggtgcggaccatgttttccagcagtcgcatgatttcagcattcaacgggtgtttctccacaggttgttgataatgatttccgtcactttctgtctgtcggcttcactgaatcccagcagttcgcgttgcggatagcggacggcattaccggcagagaccagtgacacttcgccgaactgatgaacgcgggcaatgcgggctgcgcggccttcaaatcccacgctgacgccgccgggatcggtttttaccttcagaaagcggtttgtccgaagctgctcaaacatgggtggacgcttaatggcgctctgcgttcgcctgcgggtgtcaatttccaggtattcttcaatatcggctttgtggaacgagcgtattccccggcgctccgtgtcgtaaccggtgatcatggggccgtaccggccggttgttgtccgccagtttttcagtcgtctcacctgagtgccgttccagatgaacaccacacctgcctggacacggaatacacgttttttacgggcgggccaccggttaccgtccggtgattgttgcgaacgtatacgcttttgttgcgcggcgcggacagcctgaccgacagcacgggctgttttgtttataccggcagcggacaaaccactgaggatctcctgaaagagaccgtccagtctgtgcaggtcatccggagccatcattctgaccccatgtgacatcttcgagggtgacgcgccatgcttccagggcccggctgacaggcggctctccgatgtgttctgcgtgaacagtgccatcatcattacggcggataatcacccgctcccataccgggatttccagcaggatatcggtgctgtcgtcgtcattgatggcaacagaaaatttgatatccctgtttttctccggattaagcaggagatcaggctgattgcggtacagccagcgcatcagcggcaccatcagttcatcgagatcctgcgtgaagtccatgacaaagatcccaagcgtgtaacggtaaagatatgagggggattcgccggtcgtctcaatgcctccgttattcacatacacagtgaatttctccgggttggcgcgacaccatgggcaggcgtcagtcatggcgtcgcgcagggtgttaattttcagcatgccccctcctgtgtgttatggcatgttctggttgttctgttgtgcagacttctgactgattttttcagcggcgcgctcgtcaatttttcgctgaaaataatttctgataacactgtaaccgccgctgatcagatacagcgcgcagacggcagtacagaaatacagcatgatctgatgaatgaataacataatcacctcacacaaatgattgacataacgatgtctggcgttttaaaaaaaatgaataacaataataaacactctccataattcctcttgcgctcccgtcaggtatcttttcctctcagtcttgcctgccgggagcctcttttttcttatgcggcgttgctgttattgatatccaccgtcacatactcaatcagcacggggtaggtgtcctggttactggtgatatccgtgatcagcagtttgtcgttatccagtcctgccgccgggcatttcgccagattaaaggccgcctgggtctgaccgttgatgaccggtgtcacgctgatgctgttatttccggcaaaccggaacaccacgttgtgccagttatgattaaatgccccgaaggttcccagttttgcattctgttgtttgtgctgcatcagattcaggtttgcgctgtcgctctggatgaagaaggcggccagcatatcgtttcctgcgctgccttccagaacaacgttttcaggtagctgagaaaccggccagtgcagagccatggcgaagcggttttctgccagctgaacaccttccgggattttgaaacgaaaggcaatttccccgcctttctgaagtaattcagctgctttacttgcaggcacatcgtgggcgattttccaggctgtttgttgcccctggactttttccactcgcatggctttaccgctctcagcagcagagtcatttacgacggaggcttttccatctgcccctgtccagccctgttctttcagtttcccttcctgtgcgtctgcgcgataagcgacggccgttgttcttgccggtgatgactgcgtacctgcgcccggctgaggtgcaggtgtggagggctgcgggctttccgtggtggtgctgtctgaaccggccgtggcgggaggtattgcgagcacgctgaacggtgcgggtgcacctttcaggaaggcgacggtcttcccggcatgcatcaggatcgccgttgccaggcggtcagaaataatgccgcggcgggcccatgaactgaaatgcgtggcgcgatctgaagaggtccagtttccgttactacgggatgcagcaccgtaataaccggcttctgccaggtcaggatcttcggcaggcaggtttgttggcgtgttagcacctttctcatcggtcatcaggggcacaaaataaattttttgcgcttctttgttctgatatgcaccgtaaaccaccgggtactgagaggtatattgttgtttccagatataggtggtatcgccgcaaatccagggaacaagtgatgcgttgcctccggtgcactgtgcagcatatgcgctgagatctgcgcggaactgattcaccatgttcaggaataattgcgggtactgtgcgtatgttgctgatttcagatcaaactctcccagcatccagaccacggataacaggacgtttttggggtttttatccagcgcggcttttgtacgggtaagcagatcgttatacagcggtttgccgacgccccacagggatgattcggccgttgctcctgaagattcactgaatgccccctctgcgccggaagtaaacgctgaccctccacgacagcaaggtaccaggaggatccctgcatttttcgggataaacgccagtaattttttggcaatatgtaaaccctgtccgacgcagccatactgaccttttgacagatcggcgttcggatgattaaggctgctcatatcctgtacatcatggagacagtgatctgccggaataatatcgttataggtacatgcagcgccgcccggtgtcaccgtactgcgacgcgctaactgtttaattcgtggatcaggactgtcgaatgtatccggtaatggcagcccctcaccgtatgccatgccattggactgaccagccagtggcaccacataataaaactctggctcagttgtgtgtccagtgttgtatccgtcggtagtgcccggtacgggtttttcctcgccttctggtaccggaatggctgatggcaggtctctgtcagtgaccagtgcctgcatcaggtaaaatggtgctcccggctctgatgctgagacaggtcccccaagaagtccccatccttccctgagcatgggcgcaagtttttcggcaagttccttgttcgtcattgccgtcacaagctgataatgtttcggtaccatagtgactccgttatttttcatgagtgttcattcgtgctgtccgctgccgctccagcccggcaatggcggctttatcggcattacaactgtccagggcatctaccagtcggtctccccagtcagccacatcagcccatatcatgtgttgcggcagcaccggtaccggcgtctgtctggtcagactttccggcacgctcccgcaaatgacgccggttttcagcggcgctggcgtgttgttgcaggctgtcagcaacatcagcagggggagaagtgcgtgcgcactcatccgcctgtaagtttttccgcatcgtttcacgtcgttcttcccctctggctgcacgctcctgatcttcgcgccggatagcggccagcgctgactgtgtctccgccgtggccttaagcaactcccggacggtcgtattgctctctttcacggctttttccagcgcttcataacgggtgctctcctgacctgagcgataggcccggatgaccaccattgcctgcagcgaaatggtcagcagcagcgcacaaaggataatgttcagtttcatggctgcgctcccgcgtctttcaggcaccagttcttaaaatcattccggcggttaaccagtccctgcgtgcgcgttccgccactgttcacaaaatctgtcagccggtaacacatgaggcgccattgccgtgtctgcgcgtgtttccagatggtggtgcgttgcggcgtgccgtttttgtttttaaaccacatcagattccggcagcccaggttaaaggcggcgtccgtcatggcttcgaatgcagactgcggcatctgctgccccctgaaattctgtgtgatgcagttctcagcgcggcgcatatcgttgatccaccgcccggccacttcctcctgtgtgtacaggcggttttccacgttaccggtggatccgcatccgaccgtaccgacccccaccagatcacggtagggtcgggcccggcactcctcccatgtggcaattttgatttgtgcctcgcgggaggttctcagttctccgggagccagggagatccccagcgccacaatggcggccacggcgtaacgcttaggtccggccatcgtgctcatcctgcttcagaagcatcattgcccggcgctctgcgtcgttcagctcccttccttctgactgcataaggattttttcaatcagttcgttgcgccttgcctgggcgatctccatcctgcggcggtgaagccaggcacgaagcagtgacagcgttcccagcacaaaaccggccacggcaattttttcgctcagcgtcatcacgccgataccggctgtcgtcactgacgcccagaacgtgatgtgatcacaaagccgctgaaacattctcacccccacaactggatcatttcacgccgggtctgcccctgcagctccggcagctccacttcctgtccggcatgcagaaacatgacggctgaaatccccggattggcggccagtaccgcctcagtcaccccctgcgtggtgccgtaatggcgctgacagagtaaatcgacggtgtcaccgtccagagccattactttcatcagaccagctccgcataaatgcgggtgacaccgcgtatgtctgatattgcccagcgggcatcccgccacaaatcctcaacctgcatgtccagcgcgtcagccctgcggtcgcctttatcggtggtatccacatcccgggtgcgctccagtacaaacgcgcgggtgagtgcgaaaacggccctgcggtagcggtggacgtgtacactctctccgttcacctgcgtggccggaacgtcagccagtgaggccgcgccttcagccatccgctcacgtttccagagctccagttcggcgatcacatgggcgaccgcttccgttgctgcatgtaacagacgggttgttgttgtcctccccggaatgcgggaagccaggcgaatttcatgcagtgagatcgccggccagaagtcacccgcgctcaccatggcgtcgccgtcatcggtgtcggtggtatctgtgtcagcgctgttcacgcggggtctggctatcagactcatgcctgtctccgtaaaaatcaggcggtgggcaaccggtaaaaagaacgcgaagcctgttcagatcaccggttgcgccgcctgccgacgaggtgcggttcgttaaatcagtttgttttgcgcgcggcttttttctggctggcagcgcttttcttttttgcgctgctctttttcccgccggtggtggttttcctgcccgttgtggatgcaggcaccacctgatttccgtctgccagtttcctgaccgcgcgctccagcgtggcaatttcacgcttcactcccgaagccggattgatccgcatggcttcacgtaacaggctcagcgacagacgcagatcatcgggagaggaggaggcgcggcgggaaaatgcgcgtgccttgtgcagttttgacctgacctggtccggcatatcctgctcactgaccaggtggttcagctcatcaagcatggcggtgtacacagacaaatccgcctcgctgtccgttgtggcctgcgtcagaacggcgtcagtaatctcttcagccagtaccgtggcggcgtcacggccaaagttatccggcagcgccagaccatggcggatcacgtactccccgatacgcagtgccagcgggtagtcacggcagtcaatggcccacaccatcatggtggtgatgacctcatcctggcgtccgctgtctcctgccagggtgccttcaatccacccttcaaagtcaggcaacagatgttttttaagctctgccctggcgacgtttgactgaatacccttcagctgcatctgtgccagccttaactggtgaaggacctgttcatgtgcggttctttcccgttgtgtttcccgggcgttcatggtcacccggttgcgggccaccgcctgttgcacatagcgttgtgccggtgtcagcatttctcagctcctgttaacgggcgcggcgcgcccgtccgggttatgcttcgggttgcggctgtccgctttcggcgttgttgtccggatcttcacctgcgaaggtgatcccctcaatcagcgcgcattttccgtagtcttccaccacgtagcagtcattcatggactggtaagtcgcgatacggttgtattccggctcctcgcgaatgaaacggcgcagtgagcctttctggaagtagatcgacaggtttttcagcgacgtgatgagcatggcgtctttcgggaagtacggcgcaagatacgtctgaagaccaccgacggtacgggacgccacaatcagctgcccggcaacaagctcagtgttcgggttggtggtgctgatggcgttaatcatgggaagacgcagtgtattgaacagatcccgccccatcagtacgaccagatccggtgcgtccttatgccattcatccagcacggatgagcggatgtcgtgcaccatggcatccgggttaccatagtcaccttttgccaccagtttgttttcatcatcgcgacgggtcagggtcatccctttaaccacgcgggtggcagccttgtcgcggatgtgtttcagccagcccgggttgacgtcctgcaggagagggttggtggcacgatcggaaatcagcgcgtgtgactccccgttgaaaccaatcatgattcgatccagggctacctggcgggtgatttgcgcgctcagcagttgctgaaagtttttctggctgctccatgcgtcaatctgtgcgtagctgatgaaggtatcgtagttcacctgctcgcagcggtaacggcgtgcatccagatcagcaactgatgcaggattgcggcgtttcactccgtcgctcgttgcgttcgtgctggcaatggggccgctggtgtcaatcaggactttttcaccttcctggtcatccacaccgataaaattgatttcctgtaacagtccggcgctttccttgatggcgttctccatcttctgctgaatggatggatccacgctgaaggttttacccaggcgctctgttgtgataccagccagcgatgcctgctgaatcatatagcgttccagactgtcacgtccttcacgggaaagggataaacgggccataaattactcttctcctgtcagaattcagccagtgtctggtcagtgccgccagcggaagtaaaacgctgctgtggatcggcatcctggtttctcagttgcgctttcagtgctgcaagctcgagactgagctcatccagcgccgttttgtcgagggcatgtttctgctccagagtgctgaaacggtcgataagatctgcatgatcggatgcgatgttttccacaacgtcgcgcagctggctgaactgctcgccatccgctgtgcgtgttttgctgatgagtgccatgacgcggctgaaccactgacggctctcttccgttcgctgttctgtggtggtaagcatctctgcttccatggcgacggtgaacatggagggttctgttgtgcacttactgaactgcatgatgctggcgcgttgctgtgcggcaaacttcaggcgttcagtgcccagacttgctggcgtgtcggtcattgccagacccacaatgtaaggccccttgacggcgtccagctcaggcaacacctcaatgctcgaatacacttttttcccgtcagcaatcatgtttttcatgcggtcggtgggttcaatttcggcatataacgctgtacgccctgccagtttcccttcggtgatttcatcagttgacagagcgatcagatcacccactgcgcagagttcactggatggccacatcgaaaggacgtgctcaatgttcacccgggaggcgtaaacggacgggtcatagttttctgcggcctgacgcagcatttcaccagaaatttcacgtccgtcgatggttgaaccggaaacggcaacgcgaaattttttgcgctctggcgtgtttttgcttcccatggaaattctccataacctggtcgtttttcccatgatggcggtagagaacggtgtgtctcaaggtgcttaagttgtatggcgacggggacaacgcgggcaggtatcaggcggtattgctgaggcttaatcttgccctgttaatgtcagggggtgcaatgatccaggatgtctttattcgtatgcgggcgaaacagctttactggcaggggtataccccggcggatatcgctcagctgatgggaataaaccagaacacggtttattcgtggaaaaaacgcgatgagtgggatgcaactcccccgatccagcgggtcacccagtccattgatgcacgcctgatacagctcaccgccaaaccggataaaagcggcggtgactttaaggaaattgacctgctgacgcgccagctgaaaaaactgaatgacggtcagggagaacaggctgtttccggtaagaagccccgcaggcgcaaactgaaaaatcacttcaccgaagagcagattgtcgcactcagggaaaaaatcctgccgtcactggcctggcatcagcgcgaatggtacgacaaccgccatcaccgcaaccgcatgatcctgaagtcgcgtcagattggtgcgacctggtattttgcgcgcgaagcactccttgatgcactgcgtgatgatgtctccgccgggtaccagcgcaaccagatatttttgtccgcatcccgtcgccaggcatatcagttcaaacactttattcagcaggcggcgctggaagttgatgtcgaactgaaagggggggacaagattgttttgtctaacggtgcagagcttcacttccttggcacatcggcagcaaccgctcagtcgtataccggacaccttaaatttgatgaatttttttgggtcagtaactttgtggaactcaggaaggttgctggggcaatggcgacactggaagggcttacgcgaacctacttttcaacaccgtcaggtgaaacacatgaggcgtatcagttctggacgggggaccgctggaacagcgaacagccacgctcaaaacgcagtgagtttgatgtttcacatgcgcatctgaaggggggcgtgctctttcctgacgaaacatggcggcagattgtcactattgaggatgctgtcgctaacggatggcggtacaccaatattggtgttattcgcagcgaaaatacagaaagtgaatttcgtaatctgtacatgtgcgaatttgtccgtgatggtgaggcagccttcagcctgagtgcgctcaccggctgcggtgttgacggctatgacgaatggcctgactggaaaccttttgctgcccgccctatgggggtgagggaggtctggcttgggtatgacgccaacggcagcagcgggaagggggactgcggggcactgtcggtgtgcgtgccgccccttgttgccggtgggcgttttcgcacggtggaaactgtcagggttcaggggatggagtttgaacagcaggccgcactgattgaggaatacacccaaaaatataacgtgaaacatatcggcattgatgtgaccggcgggaacggggagggggtttatcagattgtgaaaaagtttttcccgatggccgtaccgtacaacttcaatatcgcctccaagcgggcactggtcatgaaaatgcttcaggtggtgcgtgccggacgctgggagtatgaccgcagtgaacgtgacctgatccaggcattcgcatcggtgcgaaaaatacagacacccggcggctatatcacctacgacaccgaccgctcccgtggcgtcagccatggtgacctcgcctgggcaaccatgcttgctgttatcaatgagccaattggtgcggagcgtgaggataatcgcggctttgcaatggagttctgaacacaatgagtaaacgcaaaaatacaccggaaagcgggggcaggattcgctacacgatgcactgaaatcaacgcctgcactcagcgcattcacctttgatgggccctatgaagtcagccgcatggatctcctggataacatgtcatgtgcagataacgggcgctactttgatacccccatggactggaacgctatcgcccgtgcatcccgtcgtgcgtcctggcatcagtcggctttgtacttcaagcgcaacgccctgaacgggtgctttgttcctcaccctctgctgtcccgccaggcgttttcagcgtttgcgctcgactggtttgtgtttggtaatgcctatcttgaagtgcggcgtaacaggctgggggaaccactcctgcttcgcccggcactggcaaaatatacacgcaggggaagtgacctggatacctactggtatctcaacgacgacggtacggagttcagtttcaggaaagggactgtgtgccacgtgcttaatcctgatattaatcaggagatctacgggatgccggaatatatcggcgggttgctgtctgtcagcctgtcaaactcagcggatacattccgcaaactctactacgataacggctcgcatgccgggtgtattatctatgtaggcacatctcaggcgaatgcggaaagtgtcgaggccattaaaaaaacgcttacggattcccgtggtcgcggggcgtttaaaaacctgtttctacatgcaccgggtggtggcaaggatggtgtgcaaatactgccgttccagcagataaccgcaaaggatgaattcctgaacatcaaggggagcgcccgcgacgatatccttgctgcccatcgtgtaccacctcaactgatgggggcaatgcctgacgggaatgcggcgtttggtgacgttgaaaaagcggcgagagtgtttttcatcaacgagttgcaacctgtcatggaggccatgaagcatgtcaatgaatggcttggcgttgaggtgatgcgctttaacccctatgccctgcttctggataacgccagctgacgcgcttcgcttgtctgctgcttcgccggggcataaaaaatttatgccccgactctccagctctcttaacggaatgcggatggcgttcttctttgcagcttgctgataatatgcatcttcatactgtttactatcggcagccattccctgtcaccgtctccgttgatgaccacgcgaatggaggtatcatcttccacgcgaacccgaagagatacaccgtcttttccgacggaatgtaactccattgccaggactatgtttaccgactctccttcatcgtgtgagtcaacccatgttcttacagccatccggaatatgttatctgtgtcggttgcaatcatatttaccggaaatggcctgaagtcccgatcgtttctgcacggaaaccccgtatcaacgtaacgatgatgctcgccgtctttgtcttcccatgtctctgaaggcaattccagccactgctcataaaaagcaaccagcttttcagcctgattgcgcagaatccctgtaacctcccgcctcgcgtcccggctctttttgtttgccaggtacaaatcgcgaaaatggctcatgtcgctctcctttggtctgtttatgccagcctgtattctgcgctcacctcatattgtgcgcaagttttcacccgtgaatgactgatactttaaattctattaactttatgatttcagtgatttttgtctctcttttttatcccgttcgtcacgtccgtttccctcccgatctccgacctcgccagacgcaatcagacgcattctgacggcctgtttccctgaccatgttttgatgtggtttttcaaaactgactttactgcgtgcgtatcacgcgccatacgaccccaaataaagcaacccgccttccatccctcaattcgggcgcccttccctcgtcgcctgcgcgctgcaattgcctcgtttttcgtgcaccgtgcaaaccggcctcagccagcgccgttactgggctgaatggggatgaaacacataagaaaaattgtgcaatttcgtgcgcttttgtgcattttttatcttgcgatttttgggggtgggtggtgatgataatcatctgtctgaatcagtggtgtattgccgggtgagaactgtgaaaaattactcatatccttatttaacttttgtcacgctttctgttttgggggggatttttctttttatttggtggcgaaacgatgtttacagaattacctacctttattcgttcacgacaaactgccttgtttcagtgtctgtggtgctttcggtttttgtctcactgtgcctgttgaaaaagaacctggttgatcggtctaaatttaccggggttacatcgtatcttaagtttttttcgggtatgtgccttcttacctggatgattctgtttaccctcctggttacgctgatatattttcttccgggtgaagattcattctattccgctccctatgagtacagtcgcggtagctcaaaaagttgttcaggggcatttgttgatgatcctgatttgcaaaaaacaatctttatttgctacccatacggtgactatcaggatggtaatgtgatttatgtgaagaagcgtgtgaatgcgctgggtgcggtggtcacctatgcatacgcgacaagcggccgatttcggtttgactgaaaaaagaaatcctgtgttaccctcgctgctgagggtaacatgcgtgaagtcatcgcccggttcttgagctgataatgctttgcgtcagcagctgccagccctctttctgttgcccgtacttgtcctgatacctgtttacctgcaagtttccgtgcaccagaatcagatcgccttttctgtgttttgccagttcttcgtgctgcttcccgaatgaaataaggtaaagccacattgtggttggctgttctgcgccatggcagggtagtgataccgccagttgtgccgttgtgacgtttgaggtagcctgagtttaacggacactccttcctgaaatagaatggcatcagaaggagctaataatgagcagaaaaacccaacgttactctaaagagttcaaagccgaagctgtcagaacggttcttgaaaatcaactttcgatcagtgaaggcgcttcccgattatctcttcctgaaggcactttaggacaatgggttaccgccgccagaaaagggctcggtactcctggttcccgcacggtggctgaactggaatctgaaattctgcaactgcgtaaggcgttaaatgaagctcgccttgagcgagatatattaaaaaaagcaacagcgtattttgcacaggagtcgctgaaaaatacgcgttaatcgaacaatggcgacaacaatttcccattgaagcgatgtgtcaggtatttggtgtatccaggagcggttattacaactgggtacagcatgaaccctcagacataaaacaaagtgatgagcggctaaaactggagattaaggtggcacatatccgcactcgcgaaacatatggaacccggcggctccagacggagctggcagagaatggcatcatcgttggtcgtgaccgactggcacgtcttcgtaaggagctaaggctacgctgtaagcagaaacgcaagttcagagcgactacgaactcgaaccacaatctgccagttgcgccaaatctgctgaaccagacgttcgctcctacagcaccaaatcaggtctgggtggcggacctgacgtatgttgccacacaggagggatggttgtacctcgctggcatcaaagatgtttatacgtgcgaaattgtcggctacgccatgggagagcgcatgacaaaagagctgacaggtaaagccctgtttatggcgctcaggagccagcgcccacctgccgggctaatccaccactctgatcgaggttcacagtactgcgcatacgattaccgggtcatacaggagcagtttggtctgaaaacatcaatgtcgcgtaaaggtaactgttacgacaacgctccgatggaaagcttctggggaacgctgaaaaatgagagcctgagccactatcgttttaataaccgggatgaagccatctcagtaatacgggaatacattgagattttctacaatcgtcagcgtcgtcactctcgtctggggaatatctccccggcagccttcagggaaaaatatcatcagatggctgcttaaaaaaagaacaaatggtagtgtccgctattgccagtacacctcagttggttcctttggttgttctccttgtgttcgggtctgctgccagtcgtccctctgttgcaacctgtgttggcatatttgtctcccgtgttggttttattgttggggttagatgactggcagctcttcgccagcgccgtagataaacagaattcgcttcatgatttcgcttcgcttgcagtcctggattacggacggcttttgttgctgttcagcccgccgctccagctccagtcgttccttttccgttggcttccggtaatgcgttatcttgtccgtgtacccgtccacaaccagcagcccttcgcgtaccatctttccggcggcctgattaatgatggtccttttcacgcccagtttttcaaccagctctggcgcgctgaagcgtgcgtgcgtttccaggtagcgtaaaatgattacctttccggtcattctgggtgtcttcatttggcggctccttcgttgttccggcgttcgcggagttcggtcagtgctgccagtaaattttcccaccatgtttcttccacaaccggatttcgtcgtgaaagcagctgctgcgccgactcaatcattttcgtaagctctttgtcgctgatcctcctgatgtcgttcatggtgtgctccttcggtttgctgtttctggtcatgttcatggtcttttgttacctgcgtgattgcctgctggcggccgaatgcacatagctgacaattgccgcttttcggttaacgacggccagcgttcttgccagttcttcgttgagttttctggtctgtttttcgtggtatgcctgcatgatttttcctacgggagtcagtggttcaggctctgatatggcgcgacgagggcgcacggcaacgatgaatgcgcttctgtcggtgttggttcttgcagtcaggatgtcggtcatgacggtatctgtgctgcgatcggggtttgcgatcgtgatctccagttcgtcgcctggctgtggtcgaacactgacgccgctcagcgtcagtgccggaatgcgtccactcatgatggcgctgaaatcatggtgctggagtacacaatggaatcgtgtcatgggttcacctccggttgatctgctgccaccaggcttcgtgatttctcatcccagtgcacaatccgcccgtcaggcaggcgaacgcgtgcacctctgtgtacggaaagtgctgcgccactgtgtagctcctcgcccgtcgcgctcagtgccgacttgattacggtggtggtgacgtcagtcagcggcaatgctgtacgcacatgtatgacgtcatcgggcgtggtggggccgccggttttcacggtttttgtgtcagatggcgcatctttcagctgcctggtgagttgttttcgctttgtgggggtcagtgaccttaaccactcacccaaatcacctcccgggacgaccagtttttgttctttcctggtttccggtggtgggtttttaccctctccggtgtctgttttttcatcatggggacagttattgccacgagtccaaggtgcggcaaagccgcactcaacgtcaaaaccctcgtccgtgcggtcttcgttttccggcttacgtctgaccagtttccaggtgtccgggtgggtgcatatggtgtggcgctccccgagtaacggggcgcggacgccgtaaatgcgctgcgggaattcgccgtagtcgttggcctcatctgcggtttcgtatgcggtgcggatcaggtacaggttgcgtggaatgagcacgccgccctgacggttgatgtaggtggcaaaacaccccacgtcagcggcggccagaatggcgtcaatgtcgtcatggtccaggcgcttcggtgatgcggggttacgctccatttgtccggcaaggcggcggagttcacgccatacctggcggggcgggataccgaagaactggaactgccggatgcggtggagactcgcccaggcaatggcgttttccacggtttccgccatggtttttcccgattctttatcggcgtaaggtttgccggttttcgggtcattgtcgtgaaaggtgctggcgtccaggttcttgccaatataggttgcgatgtagcttgccggtgtgccttttgccgggtcgattttttcgcacttgaagcgcggagaaatatcattccccagttctgcgcgatctgatttgattgctgcgtcacgcatgatttcaatgatgcgttcttcattgtccggggcggtgaataccagcatgtgccagtgcggtgtgccgtcatggtgtggctcaacggtgcgcaccccgtaccagctcaggccttctttgttgagtttttttcttgcagctgcaaagacgtcgtaaaccagataatcactggcatcgcgcacggtggcaccgttgtatttcgggttcaggctgccgtcctcgtttacgctgtgaaagcgggaagggcaggtcactgtcacgaagaacgcggagtcaccacgcgattcggcgacctgttccatccctctgacgcaggccatcatctcgttgcggcggttgcgcggattccccagccctgaccagtacacgtcctccagactcaggcgttcaccgtcttcgttttcaatgtcccagcttttgagaaaatcacgggtgcgctggcgtttctcccggaattcctggagtgactcatggctgatgtagggggatgccttgcgcgatactcttccggcggcacgcagtaattcctcccgccagagatcagcgaggtggcgcagctggttgttccaccaggtagcgcaggtgatacgcattaccgcgcccggtaccagttcagggtctggtgccgtgcggcggtcacgtctgatctcgagtgacggccagtatggtgggttcacgcccagttttattgccatgcgcgccagctgctggtaagtcagcaaccaggtaaacaggttatcgtcgccttttcctgtccgctcagtaacttcatcacatatgcgttccagttcggtggaaaatgccgccgccgttagtgtggcaaggcgctgaatttgatcacggttgagttgtggcagcatgagtaattcatcaaggcgatggcgtgctgcggtggctttgaatgccgtcgtggcgaagcattcattcacctgttcgatgcgtttcaggcgtgtgcgcagtccacggcgaacaaagttatcagccacgtgtgtattgttgtttttcacgccttcatggcgggcgctttgctgtttgcggtttaaacgcgtcagatcacgaatgagcgcgttgccaagaaacgagggcagggcgcgaagttctgccatggcttccgataccaccgtgggcggattctcgcgtttgtgccgcgccagtttttccagtctgatccgacgctcttcgttgtggtgaaggtgcgaattaattcgcttcccttcgtctgtggttgtcagaaaggcgacggtttcttcatccagtctggcatcaatgcgaatgtcctcgttgatgtagctctgaatggcctggcgtaatgcggttggctgtgctctgccgaacgtttcaggatcgataaccggtagcggggcgttccacgggtacgccagttgtgcgttatggtcgctcatgcgtcgcactccccggcagttgccacctgaaacgccgcgcggtacagcacgagaaggcgctggtattcgccgataaaaccttctgcggtgtatatacctttcacggccacgctgtgggttgtcatttccagaaccagcgccatctctgatgacgaccagctgatggcggtactgtcggtgccgttgatgtgaaataaacccagtccatcaccatcacctttcacgtccacgcggtaacgaccgtccacggtgaaggagaaatccccgtatgtggtgacgctgcgggcagcctgtttacaggcgcggcggtaatagtcgtgccagttgttcaggcgggaagccagcaggggatccaccgcccacatccagttaaagaagtcctgaatatctgaaagtcccttaacgctcttcatgagaacctccggtaacagacgtgcggaagcctcccgcgtgcaggtgtgggatagcttccggatgtggtttatcggtgctggttgatgaggctttgcagttctgccagatcttcggcgagatagctgaagacagcagcgcagtaacggtttgacagcgcgtgcgtgcgctcatgcagcatgttgatatgcatgatttgtgcgacgcgtgttgcgcggaaaagtctgcggttgatttcgctgcggatgtgaagacgctcagcgcgggcgcgctgttgcttgcggtttgccatggtgtggcctctttgctagtaagttgtgaaaactcaccatccagagctgcgaaactgtgggtggcgagacgtacgaggttcgcagtaccggctagcaaagaacccggcccgaccgaagtcggccccgtacgccccgccataattctgacgcgaaaaagacgtggcaatacagtacgcacaaaaaaaccgctggcgcggttgtgcgctttgctagtcggcaggctgcgaaacccggcacccgttttatgaggtgcagcggaaatgtaacccgacacgacgagcgctggcaagcggtttttgtgttgcgtgttgatgtggttagaatgttgcgaattaatatcacctggcaactggtgattgtctgcatacgcggggtgtttctgatgagtgataagctcccttctgattacgaaattctttttgacctgtggtacagctactggcttgaacacatgacaaaccttctccaccgtcgcgcttccttggttctgaggattagcgctttccttgcgattgttgccgcattcattttttgcgacagcgcaacgtttgttttcgccagtgtggtgctctttctggtgtggcaggtcatggctgcctctctttctatcagagctgaaaaggctgaatggcaggcgcttagctatcaaagactgattagccagcgccacgtgctcaccccggaatgcatgattgcgcgcctctcctttgttgaggaaagtgacagccccgtgatggagtgcatgatcaaccttgcctggaataaagcctgtgagacggttggtagctcttcgcgcaatcatgtttcgatctccggtcggttactcagtcgcctgtgtggcttttgatttgtgaagcagctgcgcgacggtttcgccggctgcccggttttccgggaatgacactggcatgttcagtttgagtgccattacgtactccgcccgcgcgccagctgaatccacccagccttccagtaagtaaatggcatcggcacacatgagcatcggaatacaaatgctcatgtactgctgctggcttaatccttccggcaacgtggcagggttcagcacaacgtgcccgtctgccgcgagcctcatcgcctctgtgaaaaacgccgttctgttgtgatctttgtatccggtcattggaccggcgatataaatcactgccatgctttacctcccgtattgcgtgttgctgtcagcacgcgtacttcttccatgttcgtggcgcagaagtgcgaaccgttgataaggcggatgtgatgcatctcagaattgcgtgagtcctggcgtgtcatgccctggtcaatcaggctttcgtctacctcgtactgacggccgttggctgtgaaccggataacggttgattcctggatcattgctgactcctttgcccggcagatttctcgttgagctgctttttaagggtggcgatttcactttcctgatcctgaatcacccggattgcttccatggtgatcctcagtgagattgctgaagcgataacgagatctggtcttccagcagctgcgataacttttgctgcttcctcatgtgcacgggcgatgagacgcaattcccgcaaaagctctttgttgttttcgctattcatttcctgactccggtgttactgattcatctgtttattcacgtactggcaggggtaaacatcacgctgtaagttgcatctcccgttacaggtccgcagtccgggcagtagccaccgccatggtgaccgcaggcgtcgcactgtctcagggtggcgataacctccggtgctgattcccgggttcttgcgccaacgcttcgtggtgcctgtatgcagttcatccggtaaccccgataaatgcgtcgtgtttccggtgtgtcggaattggagatggtgatgctggtcatgccgcccgtttcctgtgaaaggcggtcaagcgctgccctcagacgaacgtgctcgtcttcatcgaatggttttccgtaggcggtaaaattgtcccggccactgaattgcaggtaagggggatcgcagtacacgcaaagcgtgttgcccatgccgaacaggtgactggcagagttcagcgtatccttaaaatctgcgtggataagcagcgttcgggtgctgtttgccttgtctgcaaatgcgcggatttcacgctcagggaagtagggcttgcggtagcagccgaaaggcacgttaaaatcgccttttccgttcacgcggaacaaaccgttaaagctgtgccggttcaggtacaaaaacatggcggccagtcgcagttcacggcggtcgcttattcccgttctgctgttcaggaaggcatgattctctgcgttaaaggtttcgcgaatgatgagatagtcacccctgttgttgtggttcaggaacagggttttcgcctcgtcgatcaggctgtcggtgttgtccctggcttgccggtagaaattaatcagcgcaccattggaatcacccaggatgtaacgcttgtaactggtgttcatgaataccgatgcgccacccacaaacggctcaaccaggcagtctgcttctggcagatgcgccttcagtgtgttcatgatgcgactttttccgcccacccatttaagcggcgtgccggataacagttctttgctcataacgcggcctctttgttataggtttcgtgcgttaataaatcccatgacgccccgttgtttttgctcagcaatcgccagcgaaaaccgattcttattaccaggtagtcgtggggttttatgcgtgaaaaattccgcacgccgtcgcggaataaacgcagcgatgcgcgggcttttctttccacgttcaggggggggcagcaacacacattcaggatggcgaccatggcttcacctcatatgttcaggaatggtgttgtgaagcgctgccagatttctgacacgacctttgcctggtaaacggcatcgcccagtgcagtgtgagcaatagcctcctttcctgatctgcctggcattttccatccagttgattcagccatggcgataagcgggcgcatacagcgctcgttccagtagcaccaggggatgcttttttctccggctgtgcgtgttatggcggatttcaggatcgggaaatcgaaggatgcgcctttgcaccatatggtcagtgaattgcccgggctttcgtcatgcatattgcgtgaaatgaacgccagaaattcggttactgccgcaagctctgttccctctgcgttgcgcaggcaggatctggcctccacggattgtccggcccaccatacagcggtggctgcattgacggttccgccgttgcgttctgaatccaccgggtcgatgaatttctcaaactgcttgcccagctttccggtgaacgggtcgaaaaacaccgccccaatcgcgaatatggctgcgcccggtccgttacccagtgtttcggtgtcaatcatgagatggttcattatgcgcaccccttcagttcgtctgggttggcgagtattgcaatcagtcgttcaatggctgcgcaggtttcctgtggacaggtgtgtgtctctttcgctgtctcagtcagctcgcgcagtaattcgcagatatgtgcacgctcggcttttcttgcggccatgctgatatgcgcatgatggttagctggtctggcggttatttctctgccgggtgattcggctgttctcatttgttgactcctgaaaaaaagacaaagggaacccgaaggcatgaatgccttaattaattgctcgtgtgttttctggtgttattccgcgcctgctttcggcttcaggttattcccagatcttcagggctaaccagataagcgcactcacctgaaatatcacccatacagtggcgatggtgtgtattgcttttacattcttcataaggttttcgctttatttacggcgtttatcgccggtaaagaataattcgatatccttcagtgtgtagataattcgcataatgccgattgccataagcacggagataatcagaattacccatgaaagaaatatgctcatgcggctacccctgtgaagtaaggctcaacaatttcaccttcaaacagttctgtcataatcgactttaattcttccagcgcttcacggtcatcgctgcccagtgcgcagttgtatagccccataattgcgccgcgcagtgagttacgaaggctttcatccttagttacgccccggtttgcaagttcgaagtggtaacgctgcaacgcgttattaataagtattttgtaggcttcgatcatggctgaatcctttatttatcagtgcttgcttcccggatattgaaaacgcaggccgttgattaatctgtctgccgttcttaaggcttcaaaaaatgtgaaatcctgtccgaagtaatcatccccgcgagtcagggtgaaattaaatctgccagtaacagggctgcgaaaacttttgtgaataacgatgccagtgtcgccaatcgtccaggtgtgcttgccggtttgttttaccgggtgaccgtctggtgtggcatggatttcagtggttgtggtcgcactatttttgcggaagtgctggcgtgcaacgtggcgttcggcacttgttcgaaaattctgctgtgaaaaatttcccggtttcttcataaaaatccctactgctgctgtgaatttgtgccgggtttttagccatgcccggcgcatggttttgtagtaatttcgttacgccttgcaattcttgcccgaactgttgtaacgataaccaaccacacaaaggagtatttatgttttctcataaactatttcggcaatttgcactgcattgagactggtatcgagtaaaccagtcgtcgttttggcggtattcgcagtggaaatgttttgtcacgggagatgttgatactctgcatcttgacgatgctgtcttccgttattttttcctttatccactcaagtaccgttacggcctcttcgtaagaataattattcagggcaatcaacattgactctgttgcatcctgtaatcgtttcacaaaataatccggagatttctctttattcatatgaaaattatccttacatccgaatctgggcggtggttttgggttttgcgtgctgccgaacgtgagcttgcaagaagtgaggggtttcacagttttgttgatgcccgtgctcatgcagaactctttcgtattggcgcgcgttcccctgtgattcttcgctctgtaaaaaaatgtgctcagtcactggtgaatgataaatatcaccttgtcttcttggttacggaatctacgtctggtttttgcttgtcactttcgtatcctgaaaacattcacttgtatgatgaggtgtttgagtcttttgaaggtgccgaatcgtttgctcaacatctctcatacgatgtgttcgaactggctgatatttatgattgttgggggtcgcttattcatcccttgcaacattctcgtttttacagaaatgtgtttgatattgatgatgatcatccatcagcctggtaggctgcttgcataacaaccattttccacagcatctgcggcgaaatctcattcctgggatttcgctgttgccggtttgttttgatgtcactggttgcctccactgtattggtgttgctccagttttgactttcttcctgtgtaaacccgctttccattgatggtctggcagtcttctttgtttgccggggaaaactttcttttctgtcggtcgtatgtccagtagcttttccagttgtgccattctggcggctcgcattctggtagttcgtcagccagcttgtcccactctctggcgttaaaccaccacacgccatccgaattttcatcttcagggtttgaacgggtcttgtgtccaggcatctgatttcgctgaagcgccacgcgcaatgcagcttttgtcaacccgatataggctgcccctttttcaagtgagcaaagtccggctaccgggccatccagtcgcaaggttgccccttttttgtaggtgcgttttttcttttcctcttggtgttcatcgtcgtttgccgcgccaacggattcggtgatgctgtcgttttcctgaagggcttgtgtgtcagataactctttatcggcaattgacttccgcatttgctatcctcttgcgttggtgcgcttgtcgcgcatcatgaaggtttgttttgatttgtttacttcaccctgtggtgaagttcgaatagaggatactcatcgtatggtgaacatgtcaagagattacgccaaaaaactaaaggcaatcagaaacgcggaaaaccttacacaatctcagttttcgcaagtaacgggagtttctgtaggaactataggaaattatgagtctggatataaacctgcgcgaattgaggttgtagaaaaagtaatccaagtcgagcgattcgaaaaatacactatgtggatacttcacgacaaaacatttcccgctgccgggcaggttgccccggctctctctcttgatggctccattcagtcggagggcgatcaggtttcaatcggcattacccaaaaatcaccccgatctcgtcgcaatgctggctaacgctgtacatcgagcgggtttcatcccgtagagagtgtacggctgattcatccgttggaggggctaatcatgtcgattaagcaactcaaagacgggcgttataaggttgatgtaagaccgcaagggacggaaggaaagcggatccgtaagatttttaccctgaagtcaaaggcacaggagtttgaaaggtatgttttgcagaatttccacgataaaccgtggcaggccaagccagctgatcagcgtcggttatccgaactgatagatgcctggtgggtgcttgatggccggaatcagccttacggggatacttacagggtcaggctggaaaaaataaaccgtgagatgagggacccctgcgccagtgagatgacgcgaaagtttatgctcgggtatcgttcagacaaattacaggccggattaatgccctccagtgttaatcgtgatttgtgcgccttgtctgcaatgtttacctcgctgattgatgcggaggttttccataacgaaaacccggtgcgtggaatacgtaagctcaaggtcaggaatacagaaatggcctttctttcagatgatgagattgatcggctgcttgaacgactcgagggggatgcgcgtcgtgttgctgttctgtgtctttccactggcgcaaggtggggggaagcagctggcttacgtggtgagcatatcgttggtaaccgcgtaatgttctttaacacaaagaatggaaaatcccgcgcggttcctgtttctgatacggtgctttcgttgataaaaacccgaaaaaccgggctattgtaccaggctgattacatccgttttcgggatatccttcaggaggtgaaaccggatttacccaaaggtcaggcgactcacgttatgcgtcacacgttcgccacgcatttcatgatgaacggcggaaatatcgttacgttacagcgaatccttgggcacaccacgattcaacaaacgatgacgtatgcgcatttttcaccggactttttacaggatgcgattagctttaatccgctggctgatagtgtccataaactgtccattgactagttgtaatttgcgttaatttgctcccctttttttgatttagtcattgaaaaataagtaaatcatcaaggggggtaaggtgtgttaaatctcctgcgggcgctttttttgtctccctttgataccgaacaataattactcctcacttacaagtaatactactttcgagtgaaaatctacctatctctttgattttcaaattattcgatgtatacaagcctatatagcgatctgctatagaaataattacacaatacggtttgttactggaatcaatcgtgagcaagcttgagtgagccattatgaaaacgaaaatccctgatgcggtattggctgctgaggtgagtcgccgtggtttggtaaaaacgacagcgatcggcggcctggcaatggccagcagcgcattaacattaccttttagtcggattgcgcacgctgtcgatagcgctattccaacaaaatcagacgaaaaggttatctggagcgcctgtacagttaactgtggtagtcgctgcccgctacgtatgcacgtagtggacggtgaaatcaaatatgtcgaaacggacaataccggcgatgacaattacgacggcctgcaccaggttcgcgcctgtctgcgtgggcgttccatgcgtcgccgtgtctacaatccggaccgcctgaaatatccgatgaaacgagtcggggcgcgcggtgaaggcaaattcgagcgcattagctgggaagaagcctacgacatcatcgcgaccaaaatgcagcgcctgatcaaagagtacggcaacgagtctatctatctgaactatggcaccggtacgctgggcggcaccatgacccgctcgtggccgccgggaaataccctggtcgcgcggctaatgaactgctgcggcggttatctgaaccattatggcgactactcctccgcgcaaattgcggaaggtctgaactatacctacggcggctgggcagatggtaacagcccgtcggatatcgaaaacagtaaactggtagtgctgtttggtaataaccctggcgaaacgcgaatgagtggcggtggggtgacttactatcttgaacaggcgcgccagaaatctaatgctcgcatgatcatcatcgatccgcgctataccgacaccggtgccgggcgtgaagatgagtggatccctattcgtccgggaacagatgccgcactggttaacggtctggcgtatgtcatgatcaccgaaaacctggtagatcaggaattcctcgataaatattgcgttggctacgacgagaaaaccctgccagccagtgcgccgaaaaatggtcactataaagcttatattctgggtgaaggacccgatggcgtggctaaaacaccggaatgggcctcgcaaatcaccggtgttccggcagacaaaatcatcaaactggctcgtgaaatcggcagtaccaaaccggcgtttatcagccagggatggggcccgcagcgtcatgctaacggtgaaatcgcaacccgtgctatctcgatgctggcgattctgaccggtaacgttggtattaacggggggaacagcggcgcgcgcgaaggttcatacagcttaccgtttgtccgtatgccgactctcgaaaacccgatccagaccagcatttctatgtttatgtggaccgatgccattgaacgtggcccggaaatgacggcgctgcgtgatggtgtgcgcgggaaagataagctggatgtgccgatcaaaatgatctggaactatgccggtaactgcctgattaatcagcattctgaaatcaaccgtacccatgaaatccttcaggatgataagaagtgcgagctgattgtggttatcgactgccacatgacctcatcggcgaaatatgctgacatcctgctgcctgactgcaccgcttccgaacagatggactttgcactggatgcatcctgcgggaatatgtcttacgttattttcaatgatcaggtcattaaaccgcgctttgaatgtaagactatctatgagatgaccagcgaactggcaaaacgtcttggcgtcgaacaacagtttactgaaggtcgtactcaggaagagtggatgcggcatctgtatgcccagtcgcgggaagcgattcctgaactgccaacgtttgaagagttccgtaagcaggggatctttaaaaagcgcgatccgcaagggcatcacgttgcttacaaagccttccgtgaagatccgcaggctaatccattgaccacgccatcgggcaaaattgagatctattcacaggcgctggctgacattgccgctacctgggaattgccagaaggtgatgtgatcgatccactgccgatctatacgccgggctttgaaagttatcaggatccgctgaacaaacagtatccgctgcagcttacgggtttccactataaatctcgcgttcactcaacttacggcaacgttgatgtgctgaaagcagcttgccgtcaggaaatgtggatcaacccgcttgatgcgcaaaaacgcggtatcagcaacggcgataaagtcaggatctttaatgatcgtggtgaggttcatattgaggcgaaagtgacgccacgaatgatgccgggtgtggtcgcactgggtgaaggtgcctggtatgacccggatacaaaacgtgtcgataagggcggttgtattaacgtactgaccactcaacgtccgtctcctcttgccaaggggaatccatcacatacgaaccttgttcaggttgaaaaggtgtaaggagtaaccgatgacaacccagtatggattttttattgattccagccgttgcaccggttgcaaaacctgcgagctggcttgtaaagactacaaagatttgacgccagaagtcagcttccgccgcatttatgaatatgctggtggcgactggcaggaagataacggtgtctggcaccagaacgtgtttgcctactatctgtcgatttcatgtaaccactgcgaagatccggcttgtactaaagtctgcccgagcggtgcgatgcataaacgtgaagatggttttgttgtggtcgatgaagatgtatgcattggctgccgttactgtcatatggcttgcccgtatggcgcaccgcaatataacgaaacgaaaggccatatgaccaaatgcgatggttgttatgaccgtgttgcggagggaaaaaaaccgatctgcgtagagtcctgccccctgcgggcgctggatttcggccctatcgacgagctgcgtaaaaaacatggcgatctggcggccgttgcgccgttgccgcgagctcactttaccaaaccgaatattgtgatcaaacccaatgccaacagccgcccaaccggggataccactggctatctggcaaacccgaaggaggtgtgagatgggaagtggatggcatgaatggccgctgatgatcttcacggtcttcgggcaatgtgtagcgggtggttttatcgttctggctttggcgctgctcaaaggcgacctgcgagcagaagcccagcagcgtgttatcgcctgcatgttgggtttatgggtgctgatgggcattggctttatcgcctctatgcttcatcttggttcaccgatgcgcgcttttaactcgctcaatcgggtaggggcttcagcactcagtaacgaaattgccagcggttcgatcttttttgctgtaggcggcatcggctggttgctggcaatgctgaaaaagctttcaccggcattgcgtacgctttggctggtggtgacgatggttcttggcgtagtctttgtctggatgatggtgcgtgtgtataacagcatcgatacagtacccacctggtacagcatctggacaccgatgggcttcttcctgacgatgtttatgggcggcccgttactgggttacctgttgctgagtctggctggtgtcgatggctgggcgatgcgtctgctgccagccatttctgttctggcactggtagtgagtggcgtgatgtcagtgatgcagggcgcagagctggcgaatattcatagctctgtgcagcaggccgcagcgctggtgccggactatggtgcgctgatgtcctggcggatcgtgcttttggccgttgccctgtgcttgtggattgcaccacagctaaaaggttatcagcctgcggttccgctactttctgtatcattcattctgcttctggcaggggaattaatcggtcgtggcgtattctatggtttgcatatgaccgtggggatggctgtcgcaagttaatcagtaacaaccggggtttcggccccggttcgcttttatttctgcttcgttaacgtgtcataactggtcatcaagttacgataatcaggaatgtggttagagaacaacgtcgccagtccttcaatatcattacgccagtcgcgatgcagctcgcacgccacgccgaaccatgtcatcaattgcgcaccagcttgcgacatgcgatcccatgccgaatgccgggtaatttcattaaaggtccctgacgcgtcagtcacgacaaagacgtcaaacccttcttcaatggctgaaagcgccgggaatgccacgcaaacttcggttaccacaccggcaataattaactgttttttacctgtcgctttgacagcttttacaaaatcttcgttatcccaggcgttaatatttcccgggcgagcaatgtaaggtgcatcggggaattgtgctttcagttctggaactaatgggccgttaggaccggtttcaaaactggtggtaagaatagttggtaagttgaaatacttagccaggtcacccagcgccagcacgttatttttaaacttatcgggttcgatatctcgtacaagggaaagtaaaccagcctggtgatcaacaagcaaaacggcagcatcatttttatcaagacgaacatacggtttggtcatcctcttctcctttcgagagtcagtggtacgtctaaatcggtcagacgtgatgcattgctctgaaagcatagacgggaaatatgagtttgctgtgaccatgaaatttttcgactgaacgaagcgtatgaaatttgtgttagatcaataaaaacaatcagatgagattaatcgtctcttcagcattagcgttatgaatgagtaatataaatcgataataccgccgctgcgatatgcgcgtattttcacccattgacaatgtttttggcggtggcatgatgcgcatgaaatttgaacttcctcacggttttaattcatgtccacgtatacccggcctgtcatgcttttgctgtctggcctgcttttgttgactctggcgattgcggtgttaaatacactcgtgccgctttggctcgcccaggaacacatgtctacatggcaggtaggcgttgtcagctcatcctattttaccggcaaccttgtcggtacattgctgacagggtatgtcattaaacgcattggctttaaccgtagctattatctggcctccttcatttttgccgctggctgtgccggccttggcctgatgattggattctggagttggttggcgtggcgttttgtcgcgggcatcggctgtgccatgatttgggtggttgttgagagtgcgctgatgtgcagtgggacgtcgcgtaaccgcgggcggttgcttgctgcgtatatgatggtttattacgtcggaacgtttttaggccagttactggtcagcaaagtctcaaccgagttgatgagtgtattgccgtgggttacaggtttgacgttggcaggaatcttaccgctgttgtttacgcatgtcctgaatcagcaggctgaaaaccatgattcgacgtcaattacgtcaatgctaaaactccgtcaggcgcggcttggcgtgaatggctgcattatctcaggaatcgtgctgggatctctatatggcctgatgccgctgtacctcaatcacaaaggggtgagcaatgccagcattggtttctggatggcggtactggtcagtgcgggtatcctcgggcaatggccgattggacgtctggcggataagtttggtcgactgctggtgttgcgtgttcaggtctttgtcgtcattctcggcagtattgcgatgcttagccaggcggcgatggccccagcgttattcatcctcggtgccgctggctttacgctatatccggtggcgatggcctgggcttgtgagaaagttgaacatcatcaactggtagcgatgaaccaggccttactgttgagctataccgtgggaagcctgcttggcccgtcatttaccgctatgctaatgcagaatttctccgataatttattatttatcatgatcgccagcgtatcgtttatctatttgctgatgctgcttcgtaacgccggtcatacgccgaaacccgtggctcacgtgtaaatgaattcaagcagagtgtgaacttactgtttcacactctgcttttctgtgcacaaaaaagcggcaacttaataaagttgccgctttacggggaaattagaacatgaccttatgaccgtactgctcaagaatgcctttcacgcgttccatggtctctttcttcggtggtttaacaccatcgagtttgtattcttcacccattgccacccatttgtgtttgcccagttcgtggtaggggaggagctcgattttctcaacgttgcccatatcacgggtaaattcaccaaggcgatgcgctgaatcgtcatcgtcagaccagcctgggacaacaacatagcggatccacaccttcacatttttgttcgccagatatttagcgaactccagcgtgcggtggttggaaactccaaccagattttggtggatctcgtcgttcatctgtttgagatcgagcattaccaggtcggttacttccagcagttcatcaatcaccggatcgtaacgacgaacaaaaccgttggtgtccagacaggtatgaatgccttcttttttgcaggcgcggaaccagtcacgaacaaactcagcttgtaggattgcctcaccgccggatgcggtaacgccgccgccggaagcgttcataaagtggcgataggtcaccacttccttcatcaaatcttcaacggtaacttctttaccgccatgcgtatcccaggtgtcgcggttatgacaatacaggcagcgcatcaggcagccctggaaaaaggtgataaagcgaatacccgggccgtctacggttccacaggattcaaaggagtgaatgcgaccaataactgacattgcggtgtttctccagatgtggcccatctgaggccgtgttggtgcgcagctcgaaggctacgtcgagtctgttttggcagtcaccttaaagtatagatagctgacaaaaaaggctctcgtgctaaaaaaggccccactttcgtggagcctttattgtacgctttttactgtacgatttcagtcaaatctaattacatagattgagtgaaggtacgagtaataacgtcctgctgctgttctttagtcagcgagttgaaacgtactgcgtagccagatacacggatggtcagctgcggatatttttccgggttttccatcgcgtcgagcagcatttcacggttcatcacgttaacgttcaggtgctgaccaccttcgatggatgcttcgtggtggaagtaaccatccatcagaccagccaggttggtcttacgaacttcgtcgtctttacccagtgcgttcggaacgatagagaaggtgtaggagataccatctttagcgtaagcaaacggcagtttagcaacggaagtcagagacgctacagcacctttctggtcacgaccgtgcatcgggttagcacccggtccgaacggcgcgccagcacgacgaccgtctggggtgttaccagttttcttaccatacacaacgttagaagtgatggtcagaacagactgagtcgggatagcgtcacggtaggtgtgcagtttctgaattttcttcatgaaacgttctaccaggtcaacagccaggtcatctacacgcggatcgttgttaccaaactgcgggtattcgccttcgatttcgaagtcgatagccagaccgtcttcgtcacgaatcggtttaactttcgcatatttgattgcagacagggagtcagcagcaacggacagaccagcgataccacacgccatggtgcggataacgtcacggtcgtgcagcgccatcagagaggcttcgtagctgtacttgtcgtgcatgtagtggatgatgttcagtgcagtgatgtactgtttagccagccagtccatgaagtgatccatgcgctccatcacttcatcatagttcaggacatcgcctttgatcggttcagacttcggaccaacctgcattttcagtttttcgtcaacgccgccgttgattgcgtacagcatggttttcgccaggtttgcacgcgcaccgaagaactgcatttgtttaccaacgatcatcgggcttacgcagcaagcaatagcgtagtcatcgttgttgaagtccggacgcatcaggtcatcgttctcatactgcagagaagaggtgtcgatggacactttagcggcgaatttcttgaagttcagcggcagtttttcagaccacagaatggtcatgttcggttccggagacggacccatggtgtacagggtgttcaggaaacggaagctgtttttggtaaccagggtacgaccgtcgaggcccataccaccgatagattcggttgcccagatcgggtcgccagagaacagttcatcgtattccggagtacgcaggaagcgaaccatacgcagtttcatgaccaggtggtcaaccatttcctgcgcttcttgttcggtgatcttgccagctttcaggtcacgttcgatgtacacatccaggaaggtggaggtacgaccgaaggacattgcagcaccgttctgagacttaacagcagccaggtagccgaagtaagtccactggatagcttcctgagcgttggtagccggaccagagatgtcgtagccgtatttcgcagccatttctttcatctgacccagagcgcggtgctgttcagcgatttcttcgcgcagacggatagtctgttccaggtttacgccgttttccagatcagcctgcagagaggtgaactgtgcaagtttgtctttcatcaggtagtcgataccgtacagcgcaacgcgacggtagtcaccgatgatacgaccacggccataagcatctggcagaccggtcagaacaccggatttacggcaacgcaggatgtccggagtgtaaacgtcgaacacgccctggttgtgagttttacggtattcagtgaagatttttttgatcatcgggtccagttcgcggttgtacgctttgcaggaaccttcgatcattttgataccaccgaacgggataagagcacgtttcagcggagcttcagtctgcagaccaacgattttctcaagctgcttgttgatgtaaccagcgtcgtgagaggtgatggtggaagcaacagcggtgtcaaagtcaactggcgcgtgagtgcggttttccagtttaacgccttccattactttgtcccacagggtggtggtcgcttcagtagcgccagccaggaaggactcgtcaccctcgtacggagtgtagtttttctgaatgaagtcacggacgtttacttcattctgccagtcacctttggtaaaaccttcccaggctgtggctaacttttcattaagctcggacatgtaatacctaccttcttaagtggattttttatttactgcgtacttcgacaaccattaatggtgatcgttttcacgcaggtaaatgacccagtatgtcaacccaaccaacaaaccaccgccgataatattaccgatcgtaaccggaatcaggttatcagtgatgaaattcatcacggtcaggtgagaaaaattttccggtgcagaaccgacagcggtccagaattccggagatgcgaagtcgcggattacaatacccatcgggatcataaacatgtttgcgatactgtgctcaaaaccgctggcaacaaacatcgcgaccggcagcaccataatgaacgctttgtccatcaggctgcggccagaataactcatccatactgccagacataccatcaggttcgccaggataccaagacagacggcctcaataaaagtatggtgcactttgtggtcggcggtttgtaggacgtttagtccccattgaccatttgcggtcatatactcgccggaaagccacattaaaagtacaaacagcagtgcgccgaccaggttgccaaaataaacatttagccagtttttcgccaactgaccccaggtgatgcgcccactcgccttggcaacaacaatcaacactgtggaagtaaagagatcggctccgcagacaacacaaagaatcaaccccagagagaagcaaatgccgccaaccagttttgccatgccgaagggcattgtacctgtgccagtggttgctgtgatatagaagacgaatgcgattgagatgaaaacaccggcggtaatcgccagatagaaagtcttaagcggatgtttcgttgctttatagacacctgcctcttcggccactttggccattgcagcaggaagtaaaagatcaaaagggttgtcagctttcacactaactctctctttattaagtcggcgacgagatactaacaaagcattatagatgagaaattgatatagatcatatctcgcctggcttataggcccgtaactcgcatggtttttatgcaaatacggagtaaatatttgattatccaaataaaaataaattttaaaaattaacaaatgagttgaattttttccgcatcctccgctaaaacagttaattaaaagggagcacctggcgaataaagtaacaatatcgatcgtatttattaaatacaaattaccgatatttaaccttataattacaattattttattaatgcaaatatatgtaaagcggggcattaaaaaaacgccccgtaatataactcagacgaatcattaagcctacattgcgtaggctatttgattttattttgcccagaatgctgctttggcgcgttgcagcttttcgtaggccttcaacaacgactgatgtgcagcaaacgcgtgcagatcgctatctactggttgcaagccataaaatgccgcttcgccgctcattgccgcactggcggcttccacggcatctgcgccgtacatgcgaacaaacgcattcagatattgcagcggctggcgatcttcttcctgcgccagtaataacaacgtttgcaggcagcgataataattggcgcgttccgggctgaatactgatgagttaaactccatcgtccattcggtccagaccagagcctgttccagatcgccaccagccagcgccagcatggcttttaattcaccgatacgcagagtgtaccagccgttatccgacccggtcgccagacccaacagttcacgcacgcgggtaaagtcatcaaaaccttcttcatccagttgctcgatgaggttcaggtaatcttccttttcccactcgctacctggtagcgaaagaatcgtttcacgtaaatggctgcccatactgttattcgccagccacagatcttcagccggataaatatcggacatgccaggcacgataatacggcaagcgtagacacccagatgctcgtaatcggcaatataaacttctttatcttcctttttgaagatagccatcagcgtggcgaactcttcttccgtggtgccggagaagctccagtcaacaaacggataatcggcatcctgcttgaacaggtcccaggagattaaaccgctggaatcgataaagtgcgtttcgaggttggtatgttcagcgacttcttcatcatcgaaggttggtggagtaaacacatccagatctttcaggccacgaccttgcagcaactcggtcacggtacgttccagtgcaacgccaaaatcaggatgcgcaccgaatgaggcaaagcaggtaccgttagcaggattgaacagtaccacgcaaatcaccggatactggccgccaagcgaaccgtcataagcgaagatcgggaaaccttccgcttccagcgtttcgatcgcttcaactactgctggataacgtgccagcacgtctgccgggatttccggcaagctgatgctttcagcaataatgcggtttttcacgtaacgttcgaaaacttcggacaacccctgaacgcgtgcttcgttacgggtattgccagcagacataccgttagaaacgtacaagttaccaatgatattcatcggaatataaatggtctgattgtcggactggcgcgtaaacggtagaccgcaaataccacgatcttcgttaccggattgcaggtcaatcagcatactaccggtcagttcattctccggatcgtaaaatgcgcgcagacggtcatcgagcagcccttctggtacatcgtcattttcggtcagtgggaaccatttttcgttgggataatgcacgaatgggccgttggcgatggtttcgcccagccagaagtccgcaaaaaagtagttggttgagagacgctcgaaatattcaccgagggcagaagccagagccgcttttttggttgcgcctttaccgttggtaaaacacagtgcgcactctttgtcgcgaatatgtacagaccagacattaggcacgggattcagccaggaggcctcttcaatctgaaaaccgaggtctgaaagtttttgctggaagcgtgcgatggaatcttccagagcggcatctttgccggggataaatgtttgcgtcatgaaaatcactttagtcgtacggaaagcgcgcaataatacgggttttatctcaaaggtgctatcaccgccgccacgctgatgaactgttagctatgcttttagcggattaactacgataagagcataaaaatgaaggcgtttgatctccaccgtatggcattcgataaagtgccttttgatttccttggcgaagttgcactacgtagtctttatacctttgtactggtctttttgttcctcaaaatgaccggaagacgcggtgtgcggcagatgtcgctgtttgaagtgttaatcattctgacactgggttcagcggcgggagatgtggcgttttatgatgatgtgccgatggtcccggtacttatcgtctttattactctggcgttgttataccgcctggtaatgtggttgatggcgcacagtgaaaaactggaagatcttctggaaggcaagccggttgtcattattgaagatggcgagctggcctggtcgaaactcaataactccaacatgacggaatttgagttctttatggagctacgattgcgcggtgtagagcagttggggcaggtacgtctggcgattctcgaaaccaacgggcaaatcagtgtttatttctttgaagatgacaaggtgaaaccgggattacttattttacccagtgactgtactcagcgttacaaagtggtgccggagtcggcggactatgcctgcatccgttgcagtgaaatcattcatatgaacgcgggggaaaaacaattatgtccgcgctgtgcaaatccagaatggacgaaggcaagtcgggctaaacgggtgacctgacagccaaaacatcggttttttgaaaataatccgagagattcttttgtgtgacgcgtgcctcatttttgccctcaacggttttactcattgcgatgcgtgtcactgaatgataaaaccgatagccacaggaataatgtattgcctgtggtcgcaattgattgaccgcgggttaatggcaacgcaacgtggtgaggggaaatggctcaaatcttcaattttagttctggtccggcaatgctaccggcagaggtgcttaaacaggctcaacaggaactgcgcgactggaacggtcttggtacgtcggtgatggaagtgagtcaccgtggcaaagagttcattcaggttgcagaggaagccgagaaggattttcgcgatcttcttaacgtcccctccaactacaaggtattgttctgccatggcggtggtcgcggtcaatttgctgctgtaccgctgaatattcttggtgataaaaccactgcagattatgttgatgcgggttactgggcagcaagtgctatcaaagaagcgaaaaaatactgcacaccaaatgtgtttgatgcgaaagtgaccgttgatggtcttcgcgcagttaagccaatgagtgaatggcaactctctgataatgctgcttatatgcattactgcccgaacgaaaccattgacggtatcgctatcgatgaaacaccagacttcggtaaagacgtggtggtcgccgctgacttctcttcaaccattctttcccgtccgattgatgtcagccgttatggtgtaatttacgctggcgcgcagaaaaatatcggcccggctggcctgacaatcgtcatcgttcgtgaagatttgctgggcaaagcgaatatcgcctgcccatcgattctggattactccatcctcaacgataacgattccatgttcaacacgccgccgacatttgcctggtacttatctggcctggtcttcaaatggctgaaagcgaacggcggtgtggctgcaatggataagatcaatcagcaaaaagcagaactgctgtatggggtgattgataacagcgatttctaccgcaatgatgtggcgaaagctaaccgttcgcggatgaacgtgccgttccagttggcggatagcgcgcttgataaattgttcctcgaagagtctttcgctgcgggcttacatgcgctgaaaggtcaccgagtggtcggcggaatgcgtgcgtctatttataacgccatgccgctggaaggtgttaaagcactgacagacttcatggttgagttcgaacgtcgtcacggctaatgtcgaaattttgcataatccccacagccagcctgtggggtttttatttctgttgtagagagttgagttcatggaatccctaacgttacaacccatcgctcgtgtcgatggcactattaatctgcccggttccaagagcgtttctaaccgcgctttattgctggcggcattagcacacggcaaaacagtattaaccaatctgctggatagcgatgacgtgcgccatatgctgaatgcattaacagcgttaggggtaagctatacgctttcagccgatcgtacgcgttgcgaaattatcggtaacggtggtccattacacgcagaaagtgcccgggagttgttcctcggtaacgccggaacggcaatgcgtccgctggcggcagcactttgcctgggtagcaatgatattgtactgaccggtgaaccgcgaatgaaagaacgcccgattggtcatctggtggatgcgctgcgccagggcggggcgaagatcacttacctggaacaagaaaattatccgccattgcgtttacagggcggctttactggcggcaacgttgatgttgatggctccgtttccagccagttcctcaccgcactgttaatgactgcgcctcttgcgccggaagatacggtgattcgtattaaaggcgatctggtttctaaaccttatatcgatatcaccctcaatctgatgaagacgtttggtgttgaaattgaaaatcagcactatcaacaatttgtcgtaaaaggggggcagtcttaccagtctccgggcacttatttggttgaaggcgatgcatcttcggcttcttatttcctggcagcagcagcaatcagaggcggcactgtaaaagtgaccggcattggacgcaacagtatgcagggtgatattcgctttgctgatgttctggaaaaaatgggcgcgaccatttgctggggcgatgattatatttcctgcacgcgtggtgaactgaacgccattgatatggatatgaaccatattcccgatgcggcgatgaccattgccaccgcggcgttatttgcaaaaggcaccaccacgctgcgcaatatctataactggcgtgttaaagagaccgatcgcctgtttgcgatggcaacagaactgcgtaaagtcggtgcggaagtcgaagaggggcatgatttcattcgcattacgccaccggaaaaactgaaatttgctgagatcgccacttataatgatcaccggatggcgatgtgtttctcgctggtcgcattatcagatacgcctgtgacgattcttgatccaaaatgtaccgctaaaacttttccagactatttcgagcaattggcgcggataagtcaacccggctgaatgaataacgggcgataacatagacaatcctttcttttcaaagacgtcggcacattgccggcgttttttttcggaccttgtggggtatttttattaatggtagcgttaattatcaatgtaacttgttgatacataatgtttatatataattaatcaacggatgattcacatgaagaatactaaattattgctggcgattgcgacctctgcagccttactgacaggatgtcagaatacgcacggtattaataccgatttggctatcagctcaggtctgaatgcttataaagccgcaacattaagcgatgctgatgctaaagcaatcgccaatcagggctgtgtcgaaatggacagcggcaataaagtggcaagcaaatccagcaagtacgggaaacgtctggcaaaaatcgccaaagcattgggtaacaatattaatggcacgccagtcaactataaggtttatatgaccagcgacgtcaacgcatgggcgatggcgaacggttgtgttcgtgtctacagtggcctgatggacatgatgaacgacaacgaaattgaaggcgttctgggccatgaactgggccacgtcgcgttgggtcactcgctggctgaaatgaaagcttcttatgcgatcgtggccgcacgcgatgccatttcagctaccagcggtgtggcttcccagctttcccgttcacaattaggtgatatcgcagaaggcgctatcaatgctaaatactcccgtgataaagaatccgaagcagatgatttctcttttgatctgttgaagaaacgtggcatcagtacccaggggctggttggtagctttgaaaaactggccagcctggatggcggtcgcacccagtccatgtttgattctcacccaccatcaacagagcgtgcgcaacacatccgtgatcgtatcgcctctggtaagtaaatcattgtcatctttcgggctggtcttctgccagcccgctataattgcgtaataaatccccatctgaatacagacaaaactggtttttgcacacaacgttaacgatttgtggcgtcggcgcgtataatgcgcgcggttatgttaacggtacgcctgttttaaggagataaagatgacggcaattgccccggttattaccattgatggcccaagcggtgcagggaaaggcaccttgtgtaaggctatggcggaagcgttgcaatggcatctgctggattcgggtgcaatttatcgcgtactggcactagcggcattacatcaccatgttgatgttgcatcggaagatgcgctggtgccgctggcatcccatctggatgtacgttttgtgtcaaccaacggtaatctggaagtgatcctcgaaggggaagatgtcagcggcgaaattcgtactcaggaggtggcgaatgctgcttcacaagtcgcggcattcccacgcgttcgtgaagcattattgcgtcgccaacgcgcgtttcgcgaattaccaggcctgattgccgatgggcgcgacatgggaacggtggtattccctgatgcgccagtgaaaattttccttgacgcctcctcggaagaacgtgcgcatcgccgcatgctacagttgcaggagaagggctttagtgttaactttgagcgccttttggccgagatcaaagaacgcgacgaccgcgatcgtaaccgagcggtagcgccactggttccggcagccgatgctttagtgttggattccaccaccttaagcattgagcaagtgattgaaaaagcgctacaatacgcgcgccagaaattggctctcgcataagcgaccgaatttgcagtacccccgttgcaatggaatgacagcgggtatgttaaacaaccccatccggcatggagccaggtggacgttaaatataaacctgaagattaaacatgactgaatcttttgctcaactctttgaagagtccttaaaagaaatcgaaacccgcccgggttctatcgttcgtggcgttgttgttgctatcgacaaagacgtagtactggttgacgctggtctgaaatctgagtccgccatcccggctgagcagttcaaaaacgcccagggcgagctggaaatccaggtaggtgacgaagttgacgttgctctggacgcagtagaagacggcttcggtgaaactctgctgtcccgtgagaaagctaaacgtcacgaagcctggatcacgctggaaaaagcttacgaagatgctgaaactgttaccggtgttatcaacggcaaagttaagggcggcttcactgttgagctgaacggtattcgtgcgttcctgccaggttctctggtagacgttcgtccggtgcgtgacactctgcacctggaaggcaaagagcttgaattcaaagtaatcaagctggatcagaagcgcaacaacgttgttgtttctcgtcgtgccgttatcgaatccgaaaacagcgcagagcgcgatcagctgctggaaaacctgcaggaaggcatggaagttaaaggtatcgttaagaacctcactgactacggtgcattcgttgatctgggcggcgttgacggcctgctgcacatcactgacatggcctggaaacgcgttaagcatccgagcgaaatcgtcaacgtgggcgacgaaatcactgttaaagtgctgaagttcgaccgcgaacgtacccgtgtatccctgggcctgaaacagctgggcgaagatccgtgggtagctatcgctaaacgttatccggaaggtaccaaactgaccggtcgcgtgaccaacctgaccgactacggctgcttcgttgaaatcgaagaaggcgttgaaggcctggtacacgtttccgaaatggattggaccaacaaaaacatccacccgtccaaagttgttaacgttggcgatgtagtggaagttatggttctggatatcgacgaagaacgtcgtcgtatctccctgggtctgaaacagtgcaaagctaacccgtggcagcagttcgcggaaacccacaacaagggcgaccgtgttgaaggtaaaatcaagtctatcactgacttcggtatcttcatcggcctggatggcggcatcgacggcttggttcacctgtctgacatctcctggaacgttgcaggcgaagaagcagttcgtgaatacaaaaaaggcgacgaaatcgctgcagttgttctgcaggttgacgcagaacgtgaacgtatctccttgggcgttaaacagctcgcagaagatccgttcaacaactgggttgctctgaacaagaaaggcgctatcgtaaccggtaaagtaactgcagttgacgctaaaggcgcaaccgtagaactggctgacggcgttgaaggttacctgcgtgcttctgaagcatcccgtgaccgcgttgaagacgctaccctggttctgagcgttggcgacgaagttgaagctaaattcaccggcgttgatcgtaaaaaccgcgcaatcagcctgtctgttcgtgcgaaagacgaagctgacgagaaagatgcaatcgcaactgttaacaaacaggaagatgcaaacttctccaacaacgcaatggctgaagctttcaaagcagctaaaggcgagtaattctctgactcttcgggatttttattccgaagtttgttgagtttacttgacagattgcaggtttcgtcctgtaatcaagcattaagggcggctacggccgcccttaatcaatgcagcaacagcagccgcttaatttgcctttaaggaaccggaggaatcatgaccaagtcagaattgatagaaagacttgccacccagcaatcgcacattcccgccaagacggttgaagatgcagtaaaagagatgctggagcatatggcctcgactcttgcgcagggcgagcgtattgaaatccgcggtttcggcagtttctctttgcactaccgcgcaccacgtaccggacgtaatccgaagactggcgataaagtagaactggaaggaaaatacgttcctcactttaaaccaggtaaagaactgcgcgatcgcgccaatatttacggttaagtttttactcaaacttgaacgcgagaaaagcacctgtcgggtgcttttttcatttctctaatctggaactggaagctgcctcgcagagttttgagcagttttcaccctatcgttaaattcttctgaacgtgcctcggggaacgcaaaactcccaccagacaaccgttcaacaaagttgcacactttctataaacagggagggtgcatgaaaataacgacagtcggcgtatgcataatttgcggaatttttccgttgctgattttgccccaattgccagggacagtaacccttgcgtttctgactctcttcgcctgtgtactggcatttatccctgttaaaaccgtccgttatatcgcgctgacgttgctgtttttcgtttggggcatattagcagcaaagcaaattttgtgggcaggagaaaccttaactggcgcgacgcaggatgcaattgttgagatcattgctactgacggcatgaccactcattacggtcaaattactcatctacaaggtcgacgtatattccctgcgccaggcctcgtactgtatggcgaatatcttccgcaagcggtttgtgccggacaagtatggtcaatgaaactcaaagttcgtgcagttcatggtcaacttaatgatggcggctttgatagccagcgttatgccattgcccagcatcaaccgctcaccggccgttttctgcaggcaagtgtcattgaaccgaattgtagcctgcgtgcacagtatctggcgtcactacaaacaacgctgcaaccctatatgtggaacgcggttattcttggattaggtatgggggaacggttatccgtccccaaagaaatcaaaaatatcatgcgtgatactggaacggcgcatttaatggcgatatcaggattgcacatcgcttttgcggcgttgctggctgcaggactcattcgcggtgggcaagtttttctgcctgggtgctggatccactggcaaatgccattaattggtggaatctgctgtgctgctttttatgcctggcttacgggaatgcaacctcctgcattgcgtaccgtggtggcgcttgccatttggggaatgcttaagttaagtggacgacaatggagtggctgggatgtatggatatgttgtctggcggcaattttgctgatggatcctgttgccattctctcgcaaagtttatggctctctgccgctgcggtcgcggcactgattttttggtatcagtggtttccctgtccggagtggcagctgccgccggtattgcgcgcggttgtttccctcatccatctgcaactgggaatcaccctcctgcttatgcccgtgcaaattgtcatatttcatggcattagtctgacctcgtttattgcaaatctttttgcaattcccctggtgacatttatcacggttccgttgattctcgccgcgatggttgtgcatttaagcgggccgtttattctggaacaagggttatggtttcttgccgaccggtctttggctttacttttctgggggttaaagagtttgccggaagggtggatcaacattgctgaacgttggcaatggctaacattttccccatggttcttactggtggtatggcgattaaacgcctggcgaacgttgccagcaatgtgtgtggctgtaggcttgctgatgtgcttgccgctgtggcaaaaacctcgacctgacgagtggcaagtgtacatgcttgatgtcgggcaagggctggcaatggtcattgcgcgaaacggcaaagcgattctctatgacacgggactggcctggcccgaaggggatagtgggcaacaactgattatcccctggctccactggcataatcttgaaccggaaggcgttattttgagtcatgaacatctggatcaccggggagggctggactcaatattgcacacatggccgatgttatggatccgaagtccgttaaactgggaacatcatcagccctgtgtgcgtggcgaagcgtggcaatggcaaggattgcgtttcagcgcgcactggcctttacaaggtagcaacgataaaggaaataaccattcctgtgtggttaagattgatgacgggacgaatagcattcttctaaccggtgatattgaagcccccgctgaacaaaagatgctaagccgttactggcagcaaatgcaggcaacattacttcaggtacctcaccatggcagtaatacctcatcatcgttgccattaattcagcgagtgaatggaaaagtggcactcgcatcggcatcgcgctataacgcatggcgactgccctcaagcaaagttaaacatcgctatcaacaacagggctataagtggcttgatactccacatcagggtcaaataacggtcaatttttcagcgcaaggctggcggattagcagcctcagagagcaaattttacctcgttggtatcatcagtggtttggcgtgccagtggataacgggtagaatatgcggctatttcaacaaatgctggttttttgaatgcataacgacaaagatctctctacgtggcagacgttccgccgactgtggccaaccattgcgccttttaaagcgggtctgatcgtggcgggcgtagcgttaatcctcaacgcagccagcgataccttcatgttatcgctccttaagccacttcttgatgatggctttggtaaaacagatcgctccgtgctgatgtggatgccgctggtggtgatcgggctgatgattttacgtggtatcaccagctatatctccagctactgtatctcctgggtatcaggaaaggtggtaatgactatgcgtcgccgcctgtttggtcacatgatgggaatgccggtttcattctttgacaaacagtcaacgggtacgctgttgtcacgtatcacctacgattccgaacaggtcgcttcttcttcttccggcgcactgattactgttgtgcgtgaaggtgcatcgatcatcggcctgttcatcatgatgttctattacagttggcaactgtcgatcattttgattgtgctggcaccgattgtttcgattgcgattcgcgttgtatcgaagcgttttcgcaacatcagtaaaaacatgcagaacaccatggggcaggtgaccaccagcgccgaacaaatgctgaaaggccataaagaagtattgattttcggtggtcaggaagtggaaacgaaacgcttcgataaagtcagcaaccgaatgcgtcttcaggggatgaaaatggtttcagcctcttccatctctgatccgatcattcagctgatcgcctctttggcgctggcgtttgttctgtatgcggcaagcttcccaagtgtcatggatagcctgactgccggtacgattaccgttgttttctcttcaatgattgcacttatgcgtccgctgaaatcgctgaccaacgttaacgcccagttccagcgcggtatggcggcttgtcagacgctgtttaccattctggacagtgagcaggagaaagacgaaggtaagcgcgtgatcgagcgtgcgactggcgacgtggagtttcgcaatgtcacctttacttatccgggacgtgatgtgcccgcattgcgtaacatcaacctgaaaattccggcagggaagacggttgctctggttggacgatctggttcaggtaaatcaaccatcgccagcctaatcacacgtttttacgatattgatgaaggcgaaatcctgatggatggtcacgatctgcgcgagtataccctggcgtcgttacgtaaccaggttgctctggtgtcgcagaatgtccatctgtttaacgatacggttgccaacaacattgcttacgcgaggactgaacagtacagccgtgagcaaattgaagaagctgcgcgtatggcctacgccatggacttcatcaataagatggataacggtctcgatacagtcattggtgaaaacggcgtgttgctctctggcggtcagcgtcagcgtattgctatcgctcgagccttgttgcgtgatagcccgatactgattctggacgaagctacctcggcgttggataccgaatccgaacgtgcgattcaggcggcactggatgagttgcagaaaaaccgtacctctctggtgattgcccaccgcttgtctaccattgaaaaggcagacgaaatcgtggttgtcgaggatggtgtcattgtggaacgcggtacgcataacgatttgcttgagcaccgtggcgtttacgcgcaacttcacaaaatgcagtttggccaatgatcgaaaaaatctggtctggtgaatcccctttatggcggctattgctgccactctcctggttgtatggcctggtgagtggcgcgatccgtctttgctataaactaaaactgaagcgcgcctggcgtgcccccataccggttgtcgtggttggtaatctcaccgcaggcggcaacggaaaaaccccggtcgttgtctggctggtggaacagctgcaacagcgcggtattcgcgtgggggttgtatcgcggggatatggtggtaaggctgaatcttatccgctgttattgtcggcagataccaccacagcacaggcgggtgatgaacctgtgttgatttatcaacgcactggcgcacctgttgcggtttctcccgtgcgttctgacgcggtaaaagccattctggcgcaacaccctgatgtgcagatcatcgtaaccgacgatggtttacagcattatcgtctggcgcgtgatgtggaaattgtcgttattgatggtgtgcgtcgctttggcaatggctggtggttgccggcggggccaatgcgtgagcgagcggggcgcttaaagtcggttgatgcggtaatcgtcaacggcggtgtcccccgcagcggtgaaatccccatgcatctgctgccgggtcaggcggtgaatttacgtaccggtacgcgttgtgacgttgctcagcttgaacatgtggtgacgattgcggggattgggcatccgccgcgcttttttgccacgctgaagatgtgcggcgtacaaccggaaaaatgtgtaccgctggccgatcatcagtctttgaatcatgcggatgtcagcgcgttggtaagcgccggacaaacgctggtaatgactgaaaaagatgcggtgaaatgccgggcctttgcagaagaaaattggtggtatttgcctgtagacgcacagctttcaggtgatgaactagcgaaactgcttgcgcaactaacctcgctggcttctggccactagttacgccgcggcagcgttcgattgatggagtcatgaatgtcgctgccgcacctctcccttgctgatgcgcgtaatcttcaccttgccgcgcaaggcctgttaaacaaaccccgccgtcgagcgtcgttggaggatattccggcaacgatctcccgcatgtccttgctgcaaatcgataccatcaatattgttgcccgtagtccatatctggtgcttttcagtcgtctgggaaattatcctgcccagtggctggatgagtctctggcgcgtggcgaattaatggaatactgggcgcatgaagcctgctttatgccgcgtagcgattttcgtcttattcgccaccgcatgctggcacctgaaaaaatgggctggaaatataaagacgcctggatgcaggaacatgcggcggaaattgcacagttaattcagcatattcatgataaggggccagtacgttcagccgattttgagcatcctcgtaaaggggcgagcggctggtgggagtggaagccgcataaacgacatctggaaggtttatttactgccggaaaggtgatggtgattgaacggcgcaacttccagcgcgtttatgatttaactcaccgtgtcatgcctgagtgggatgatgagcgcgatctcgtttcgcaagcagaagcagaaatcatcatgctggataacagtgcgcgtagcctgggaatatttcgcgaacagtggctggcagattactaccggctaaaacgtccggcactggcggcgtggcgtgaagcgagggctgaacagcagcaaatcattgctgtgcatgttgaaaaattgggcaatctttggctgcatgctgatttgctgccgctactcgagcgtgcgctcgccggaaagctcactgcaacgcacagcgcggtactttcgccttttgatcctgttgtctgggatcgcaaacgcgcggagcagctttttgattttagctaccggctggagtgctatatcccagcgccgaaacgccagtatggctattttgttctgccgttattacatcgtgggcaattagttgggcgaatggatgccaaaatgcatcgccagacaggcatccttgaagttatcttgaggtgtactggcaatagcggacactaccatttgttctttttttaagcagccatctgatgatatttttccctgaaggctgccggggagatattccccagacgagagtgacgacgctgacgattgtagaaaatctcaatgtattcccgtattactgagatggcttcatcccggttattaaaacgatagtggctcaggctctcatttttcagcgttccccagaagctttccatcggagcgttgtcgtaacagttacctttacgcgacattgatgttttcagaccaaactgctcctgtatgacccggtaatcgtatgcgcagtactgtgaacctcgatcagagtggtggattagcccggcaggtgggcgctggctcctgagcgccataaacagggctttacctgtcagctcttttgtcatgcgctctcccatggcgtagccgacaatttcgcacgtataaacatctttgatgccagcgaggtacaaccatccctcctgtgtggcaacatacgtcaggtccgccacccagacctgatttggtgctgtaggagcgaacgtctggttcagcagatttggcgcaactggcagattgtggttcgagttcgtagtcgctctgaacttgcgtttctgcttacagcgtagccttagctccttacgaagacgtgccagtcggtcacgaccaacgatgatgccattctctgccagctccgtctggagccgccgggttccatatgtttcgcgagtgcggatatgtgccaccttaatctccagttttagccgctcatcactttgttttatgtctgagggttcatgctgtacccagttgtaataaccgctcctggatacaccaaatacctgacacatcgcttcaatgggaaattgttgtcgccattgttcgattaacgcgtatttttcagcgactcctgtgcaaaatacgctgttgctttttttaatatatctcgctcaaggcgagcttcatttaacgccttacgcagttgcagaatttcagattccagttcagccaccgtgcgggaaccaggagtaccgagcccttttctggcggcggtaacccattgtcctaaagtgccttcaggaagagataatcgggaagcgccttcactgatcgaaagttgattttcaagaaccgttctgacagcttcggctttgaactctttagagtaacgttgggtttttctgctcattattagctccttctgatgccattctatttcaggaaggagtgtccgttaaactcaggctacctcatctctctgtggttacaggaaggcattaaaccaacgacaacgctgcaaaaagggttacgtcaggcgattactgatttcgctaactggcagcaggcaacgcgggtgacattaggacgctgcccgcaaggcctctttactgattgccgcgccggctgggaaatagaccccgtcgcataaatgattatgataagatttatgcattcataacccgatccatctggaggaactatggatcatcgtctgcttgaaatcattgcctgcccggtttgcaacggaaaactttggtataaccaggaaaaacaagagattatttgcaaactggacaacctggctttcccgctgcgcgatggcattccagtgttgctggaaacggaagcccgcgtgctgactgctgatgagagtaaatcatgagttttgtggtcattattcccgcgcgttacgcgtccacgcgtctgcccggtaaaccattggttgatattaacggcaaacccatgattgttcatgttcttgaacgcgcgcgcgaatcaggtgccgagcgtatcatcgtggcaaccgatcatgaggatgttgcccgcgctgttgaagccgctggcggcgaagtatgtatgacgcgcgccgatcatcagtcaggtacagaacgtctggcggaagttgtcgaaaaatgcgcattcagcgacgacactgttatcgttaatgtgcagggtgatgaaccgatgatccctgcgacaatcattcgtcaggttgctgataacctcgctcagcgtcaggtaggtatggcgactctggcggtgccaatccacaatgcggaagaagcgtttaacccgaatgcggtgaaagtggttctcgacgccgaagggtacgcactgtacttctctcgcgccaccattccgtgggatcgtgatcgttttgcaaaagaccttgaaaccgtaggcgataacttcctgcgtcatcttggtatttatggctaccgagcaggctttatccgtcgttatgttacctggcagccaagtccgttagaacatatcgaaatgttagagcagcttcgtgttctgtggtacggcgaaaaaatccacgttgctgtcgcccaggaagttcctggcacaggtgtggatacccctgaagatctcaagcgcgttcgcgccgaaatgcgctaatttcacttcacgacactccagccaattttgggaggagtgtcgtaccgttacgattttcctcaatttttcttttcaacaattgatctcattcaggtgacatcttttatattggcgctcattatgaaagcagtagcttttatgagggtaatctgaatggaacagctgcgtgccgaattaagccatttactgggcgaaaaactcagtcgtattgagtgcgtcaatgaaaaagcggatacggcgttgtgggctttgtatgacagccagggaaacccaatgccgttaatggcaagaagctttagtgcgcccggaaaagcccgacaactggcatggaaaaccaccatgctggcaagaagtgggactgtccgtatgccgactatttatggtgtgatgacgcatgaagaacaccccggccccgatgtcctgctactggagcgaatgcgtggtgtttcggtggaggcaccagcccgaacaccagaacgctgggaacaactcaaagatcaaatcgttgaagccttactggcctggcaccgtcaggacagtcgtggttgcgtcggcgcggtcgacaatactcaggaaaatttctggccctcatggtaccggcaacatgttgaagtgctatggaccacgctcaatcagttcaataacaccggtctaacgatgcaggataagcggatcctgtttcgcactcgcgaatgtctcccggcattatttgaaggctttaacgacaattgtgtactgattcacggtaacttctgtttacgtagcatgctgaaagattcgcgcagcgatcagttactggcgatggtcggaccgggactaatgctttgggcaccgcgagaatacgaactgttccgactaatggataattctctggcggaagatttgctctggagttatctgcaacgcgcgccagtggcggagtcgttcatctggcggcgttggttgtatgtgttatgggatgaagttgcgcaactggtcaacaccggacgatttagtcggcgtaacttcgatctggcatcaaaatcactcttgccgtggctcgcctgacgaacctttcagccactgccagatccggccaagcgtttcatagccaacgcggtcgctatgcatcaaccaaaccggagaagggattgcccgttcccacggattaagcggcgagtcgatggccaactgattcgccggggctggtagcggatttaacccttcctgctgaaaaaagatcatcgcccgcggcagatgtgatgcggaggtcaccagcaggaaaggtgcgtcaccaatcgcctgtttcactgctgcagcttcttcttcggtatcttttggcaaatccagggtgataatttgctcgcgcggcacgcccagcgattgcgcaactctggcacctacttcggctgtgctcaccgtattggttttagctacgcctcccgtaaagatcagttttgatcccggattttcgcgccataagcgaataccttcattcaggcgtggcagactgttattgattaaattagagctcggcgcccactgcgggttccaggtataaccacctccgagcaccacgatatagtccactttttgcgaattattccatgtcggataagtgctttcgatgggacgcaacaggcggtcggctatcggttgcaaactcaataacaagagcgccagccacccaatgctaataaaaatcttcccggttttttgaaaacggctaaaccacagcagcgccaggccagcgccaataatcaacaacatcagcggaagtggcagcaacatattaccaatcacttttttcagtgtaaaaagcatcctttctggttccttttttgaccatatagcaagggatcgccagcgatattacaccagacgggttcattctcgccgtggctgtgacaaaatagcgtctttatcagaaaacgtcttagccaaccggtggagaaagcaatgcaggatcgcaattttgatgatattgcggaaaagttttcccgtaacatttacggcaccaccaaagggcagcttcgacaggctattctgtggcaggatctcgatcgcgtgctggcggaaatgggcccgcaaaaactgcgtgtgctggatgctggcggcggagaagggcagaccgcaatcaaaatggccgagcgcgggcatcaggtcattttatgcgatctttctgcgcagatgatcgaccgcgcaaaacaggcggcagaagcaaaaggtgtgagcgacaacatgcaatttatacattgcgccgctcaggatgttgcttcgcatttggaaacgcccgttgatctgatattgttccatgcggtgctcgagtgggtgaccgatccccgcagcgtattacagaccctgtggtcagttttgcgtccaggcggcgtgttgtcgttaatgttctacaatgcgcatggtttgttgatgcataacatggtcgccgggaattttgattacgtgcaggcgggaatgccgaaaaagaaaaaacggacgctttcgccagattatccacgcgacccggcgcaggtttatctgtggctggaagaagctggttggcaaattatgggtaagacaggcgttcgcgtgtttcatgattatctgcgcgagaagcaccagcagcgcgactgctatgaagcattacttgaattagaaacgcgttattgccgtcaggaaccgtatattaccctggggcgttatattcatgtcaccgcgcgcaaaccgcagagcaaggataaagtatgagtgaattttcccagacagtccccgaactggttgcctgggccagaaaaaatgacttctccatctcgctgccggtagaccgactctcttttctgctggcggttgccacgctgaacggcgagcgtctggatggtgagatgagtgaaggcgagctggtggatgcattccgccatgtgagtgatgcgtttgagcaaaccagcgaaaccatcggcgtgcgcgccaacaacgcgatcaacgacatggtgcgtcaacgtctgctgaaccgctttaccagcgagcaggcggaagggaacgcaatttaccgtctgacgccgctcggcatcggcatcactgactattacattcgtcagcgcgagttttctacgctgcgcctttctatgcaattgtcgattgtggcgggtgagctcaagcgcgcagcagatgccgccgaagagggcggtgatgaatttcactggcaccgtaatgtttatgcgccactgaaatattcggtagcagaaattttcgacagtatcgacctgacgcaacgtctgatggatgaacagcagcagcaggtgaaggatgatatcgcccagttgttgaacaaagactggcgtgcggcgatttccagctgtgaattgttgctttcagaaacttccggaacgctgcgtgaattgcaggatacgctggaagcggcaggcgataaattgcaggccaacctgttacgcattcaggatgcgacgatgacccatgacgacctgcattttgtcgatcgtctggtgttcgatcttcagagcaaactcgaccgtattatcagttggggccagcaatccatcgacctgtggattggctacgaccgccacgtacacaaatttattcgtactgcgatcgatatggataaaaaccgcgtctttgctcagcggttacgtcagtcggtacaaacctattttgatgagccgtgggcgctaacttatgccaatgccgatcgtctgctggatatgcgtgacgaagagatggtactgcgcgatgaagaagtgactggggaacttcctgaggatctggagtacgaagagtttaacgagatccgcgaacagctggcggcgatcatcgaagaacaacttgccgtgtacaaaaccagacaagtgccgttggatcttggtctggtggtacgcgaatatctgtcacagtatccgcgtgcacgtcactttgacgttgcgcgcattgttattgatcaggcggtacgtcttggcgtagcgcaagcagatttcaccggactgccagcgaaatggcagccgattaatgattacggagccaaggtacaggcgcatgtcatcgacaaatattgaacaagtgatgccggttaagctggcgcaggcgctggcgaatccgttatttccggcgctggatagcgccttacgttcaggccgtcatattggcctcgacgaactggataatcatgcattcctgatggattttcaggaatatctggaagagttttacgcgcgttataacgttgagcttattcgtgcaccggaagggttcttctatctacgcccacgttccaccacgctgatccctcgttccgtcttgtcggaactggatatgatggtcgggaaaatcctctgttatctctatctcagcccggaacggctggcgaatgaggggatttttactcaacaggaactgtacgacgaactgctcaccctggccgatgaagcgaaactgctgaaactggtgaacaaccgttcaaccggttcagacgttgaccgtcagaagttgcaggaaaaagtacgttcttcgctcaaccgtctgcgtcgtttaggcatggtgtggtttatgggccacgacagcagcaagttccgcattaccgaatcggtgttccgcttcggagccgatgtgcgtgctggcgacgatccccgtgaagcacagcgtcgcctgattcgtgacggcgaagcaatgccgattgaaaatcatctgcaactcaacgatgaaaccgaagagagtcagccagatagcggagaggaagaataatgattgaacgcggtaaatttcgctcactgacgctgattaactggaacggcttttttgcccgaacttttgaccttgacgagctggtcacgacgctttctggcggtaacggggcgggtaaatccaccaccatggcggcgttcgttacggcgcttatccccgatctgaccctgctgcatttccgtaacactacggaagccggggccaccagcggttcgcgcgataaaggtctgcacggtaagctgaaagcgggtgtctgttattcgatgctcgacaccattaactcgcgccaccagcgtgtagtggtcggtgtgcgtctgcaacaggttgccggacgcgatcgtaaagtggatatcaaaccatttgccattcagggcctgccgatgtcggtgcagccgacacaactggtgaccgaaactctgaacgaacgccaggcgcgcgtgctgccgcttaacgagctgaaagacaagctcgaggcgatggaaggcgtgcagtttaaacagttcaactccattaccgattaccactcgctgatgttcgatctgggcatcatagcgcgtcgtctgcgctcagcgtctgaccgtagtaaattctatcgtctgatcgaagcctcgctgtatggtgggatctccagcgccattactcgttctctgcgcgactacctgttgccggaaaacagtggggtgcggaaagcgttccaggacatggaagcggcgctgcgtgaaaaccgcatgacgctggaagcgattcgtgtcacccagtcggaccgtgacctgtttaagcatctgattagcgaagccaccaactacgtggcggcggactacatgcgtcacgccaacgagcgccgtgttcatctcgataaggccctggagtttcgtcgcgagctacatacttcgcgtcagcaactggcggctgagcagtacaaacacgtcgacatggcgcgagagctggctgagcacaacggtgccgaaggcgatctggaagcggattatcaggcggccagcgatcacctgaacctggtgcaaaccgcactgcgtcagcaggagaagattgaacgctacgaagcggatctcgatgagctgcagatccgtctggaagagcaaaacgaagtggtggcagaagccatcgaacgccaggaagagaacgaggctcgtgcggaagctgccgaactggaagtggacgagctgaaaagccagcttgctgactaccagcaggcgctggacgtccagcaaacgcgcgcgatccagtataaccaagcgattgctgcgcttaatcgtgccaaagaactgtgccatctgccggacttaaccgccgacagcgctgccgaatggctggaaaccttccaggcgaaagagctggaagcgaccgaaaaaatgctctctcttgagcagaaaatgagcatggcgcaaaccgcgcacagccagtttgagcaggcttatcagctggtggtggcaatcaacggcccgctggcgcgtaacgaggcgtgggatgtcgctcgcgaactattgcgcgaaggggtcgatcagcgtcacctggcagagcaggttcagccgttgcggatgcgcttaagcgaactggaacagcgtctgcgtgagcagcaagaagctgagcgtctgctggcagatttctgcaaacgtcagggcaagaattttgatattgatgaactggaagctctgcatcaggagctggaagcacgcattgcctctctttccgatagcgtctctaacgcccgagaagagcggatggcactgcgccaggagcaggaacagctgcagtctcgcattcagagtttgatgcagcgtgcgccggtttggctggcagcgcaaaacagtctcaaccagttgagcgaacagtgcggcgaagagttctcctccagccaggacgtcaccgaatatctgcaacagttgctggagcgtgagcgcgaggcgattgttgaacgcgatgaagtaggcgcgcgcaaaaacgccgtcgatgaagagatcgaacgtttaagccagcctggcggctctgaagatcagcgtctgaatgcgctggcggagcgttttggcggcgtgctgctgtcagaaatttatgacgacgttagcctggaagatgcgccgtacttctcagcgctgtatggcccgtcacgccacgccatcgtggtgccagatctgtcacaggtaaccgaacacctggaaggcttgaccgattgcccggaagatctctatttgatcgaaggggatccgcagtcattcgatgacagcgtgttcagcgttgatgagctggaaaaagcggtagtggtgaaaatcgccgatcgtcagtggcgttattcacgtttcccggaagtgccgctgtttggtcgtgctgcgcgtgaaagccgtattgaaagcctccatgccgagcgtgaagtgctttccgaacgcttcgccacgctctcctttgatgtacagaaaactcagcgtctgcatcaggcgttcagccgctttataggtagtcatctggcggtggcgtttgagtctgacccggaagcagaaatccgtcaactgaacagccgtcgcgtcgaactggagcgggcgttgagtaatcatgaaaatgataaccagcagcagcgtattcagtttgagcaggcgaaagagggcgttacggcgctgaaccgcattctgccgcgtctcaacctgttggctgatgatagcctggcagatcgcgtcgatgaaatccgcgaacgtctggatgaagcccaggaagccgcgcgttttgttcagcagtttggcaatcaactggcgaaactggaaccgatcgtttcggtattgcagagcgacccggaacagttcgaacagttaaaagaagattacgcgtactctcagcagatgcagcgcgatgcccgtcagcaggcgtttgccctgacggaagtggtgcagcgtcgtgcgcactttagctactctgactcggcagaaatgcttagcggtaacagcgatctcaacgaaaaactgcgtgaacgtctggaacaggcggaagcggagcgtacccgcgctcgtgaagcgttgcgcggacacgcagtgcagttgaatcagtacaaccaggtgctggcttcgctgaaaagttcgtatgacaccaaaaaagagctacttaacgatctgcaacgtgaattgcaggatatcggcgtgcgtgctgatagcggggcagaagagcgggcacgtattcgccgtgacgagttgcacgcgcaactgagcaataaccgttcacgacgcaatcaactggaaaaagcgcttacattctgcgaagcggagatggacaacctgacccgtaaactgcgcaagctggagcgggattactttgagatgcgcgagcaggtagtgaccgccaaagcgggctggtgtgcggtgatgcgcatggtgaaagataatggcgttgagcgtcgcttacaccgtcgtgagctggcttatctctccgctgatgatttgcgctccatgtcggataaggcgttaggtgcgctgcgtctggcggtggcggataacgaacatctgcgcgacgtgctgcggatgtcggaagatccaaaacgtccggaacgtaaaattcagttcttcgtggcggtttatcagcatctgcgtgaacgtattcgtcaggatattattcgtaccgatgatccggtggaagctatcgaacagatggagatcgagcttagccgtctgaccgaagaattaacctcccgtgaacagaaactggcgatcagttcccgcagcgtggcgaacatcattcgcaaaaccattcagcgcgagcagaaccgtatccgtatgctcaaccaggggttgcagaacgtatcgtttggccaggtgaacagcgtacgtctgaacgtgaacgtacgtgaaacgcacgccatgctgctggatgtgctctctgaacagcacgagcagcatcaggatctgtttaacagcaaccgcctgaccttctcagaagcgctggcgaaactgtatcaacgtcttaacccgcagattgatatggggcagcgcacgccgcagaccatcggtgaagaactgctggattaccgcaactatctggaaatggaagttgaggttaaccgtggttccgatggctggctgcgcgcggagtctggcgcactgtcgaccggtgaggctattggtaccggtatgtcgattctggtgatggtggtacaaagctgggaagatgaatctcgccgcctgcgcggtaaagatatctctccttgccgcctgctgttcctcgatgaagcagcgcgactggatgcccgttccatcgccacgctgtttgaattgtgtgaacgtttgcaaatgcagctcattatcgcagcgccggaaaatatcagcccggagaaaggcaccacctataaactggtgcgtaaagtcttccagaataccgaacacgttcacgtcgtcggcctgcgaggatttgcgcctcaactccctgaaacgcttccaggaagtgacgaagcgccttctcaggcgagttaaaattaaggcggcagcaatgccgccttttctttttccgaaaactccgtttctgcactaaaaaagtggcacattacggcgcgcttttctttaaacttctttacattaggttatgtaaaaacgtatcggcgtttatatactgaagataagcctgatgagtaacaggcttgctcgtcatactttcgtgagtattggcgttgtacaggcaagtcgtaaaataacagcctggctattcagagtatgataaaaacagggggcaagggatgttgcttaatatgatgtgtggtcgtcggctgtcggcaatcagtttgtgcctggccgtaacattcgctccactgttcaatgcgcaggccgatgagcctgaagtaatccctggcgacagcccggtggctgtcagtgaacagggcgaggcactgccgcaggcgcaagccacggcaataatggcggggatccagccattgcctgaaggtgcggctgaaaaagcccgcacgcaaatcgaatctcaattacccgcaggttataagccggtttatcttaaccagcttcaattgttgtatgccgcacgcgatatgcaacccatgtgggaaaaccgtgatgctgttaaagccttccagcaacagctggcagaggtggcgattgccggtttccagccgcagtttaataaatgggtagagttactgaccgatcctggtgttaacgggatgacacgcgacgtggtgctctctgatgcgatgatgggctatctccatttcattgcaaatattccggtcaaaggcactcgctggctatatagcagtaaaccttatgcgctttcaacgccgccgctttcggtgattaaccaatggcagctggcgctggataaaggtcaattgccgacgtttgttgcaggactggcaccgcagcatccgcaatatgcggcgatgcatgaatcgttactggccttactcagtgacaccaaaccgtggccccaactgaccggcaaagcaacgttgcgcccaggacagtggagtaacgacgtaccggcgttgcgcgaaatattgcaacgtacaggcatgttggacgggggatcgaaaattacgctacctggcgatgacacgccaactgacgcggtagtcagcccatccgctgttactattgaaacagcagaaactaagccgatggacaagcaaactacgtctcgtagtaaacctgtgcctgtcgttcgtgccgcctacgagaatgaactggtggaagccgttaaacgttttcagacatggcaaggattgggagcagatggcgctattggcccggcaacgcgtgactggttaaacgtaacgcccgcccagcgtgctggcgtgttggcactcaacatccagcgattgcgcttgctgccaacagagctttctaccgggatcatggttaacattccggcctattcgctggtctactatcagaacggcaatcaggtgctggattcgcgagtcattgtcggtcgccccgatcgcaaaacgccgatgatgagcagtgcacttaacaacgtagtggtaaacccgccgtggaacgtaccaccaactctggcacgcaaagatattctgccgaaagtgcgcaacgatccgggatatctcgaaagccatggctatacggtgatgcgcggctggaacagcagagaagcgattgacccatggcaggttgactggtctacaatcacggcctcgaatttaccgttccgcttccagcaggctccaggcccacggaactcgctggggcgctataaattcaatatgccgagttcagaggccatttatttgcatgacacgccgaaccacaatctgttcaagcgtgatacacgcgcattgagctcaggctgtgtacgagtgaataaagcttccgatctggcgaatatgctgttgcaggatgcaggctggaatgacaaacgtatttctgatgcgctgaagcagggcgatacgcgttacgtcaatattcggcagtcgattccggtgaatctctactatctgacggcctttgttggtgcagatggtcgtacccagtatcgtacagatatttacaattatgatctgcctgcgcgatccagctcgcaaatcgtatcgaaagcggaacaattaatcaggtaaatgaagcagttcggggaaatcagttgtcgtaataattagcataatcgggggcgattctctgcagcccccgtcactgctggggttgagtcatcttgacgtctgctttacgggcggttaaggtgcctcttgtgcgccagaagtgcatataaacgataacattgacctgtagacttgattatcatggacaaattcgacgctaatcgccgcaaactgctggcgcttggtggcgttgcactcggtgccgccatcctgccgaccccggcgtttgcaacactctctaccccacgcccgcgcattttgacactcaataatcttcataccggagagtcaatcaaagcggagtttttcgatggcagaggctatattcaggaagaattggcaaaacttaaccattttttccgcgattaccgcgcgaacaaaataaagtccatcgacccaggattattcgaccagttgtatcgcctgcaagggttgttaggcacccgcaaaccggtgcaactcatttccggttatcgttccattgataccaacaatgaactacgcgcccgcagccgtggagtagcgaagaaaagctatcacactaaaggccaagcgatggatttccacattgaaggtatcgcgttaagcaatattcgcaaagccgcgttatctatgcgcgcaggtggtgtaggatattacccacgtagtaactttgtgcatattgataccgggccagcacggcactggtagtaatcgcttaacgaaacaggggcagtatgaactatcgtattattccggtcaccgcattctcccagaactgttcattgatctggtgtgaacaaacccgtctggccgcactggtcgatcctggcggcgatgcggaaaaaatcaaacaggaagttgatgccagcggcctgacactgatgcagatcctgctgactcatggtcatctggaccacgttggcgcagcggcggaactggcgcaacattacggcgtgccggtttttggcccggaaaaagaagatgagttctggctgcaaggcttgcctgcgcaaagtcgtatgtttggtctggaagagtgccagccgctgacgccagatcgttggctgaacgaaggcgataccatcagcatagggaatgtgactttacaggtgttacattgccctgggcatacgccgggtcatgtcgtgttttttgatgatcgggcaaagctgctgatttctggcgacgttattttcaaaggtggagtagggcgcagtgacttcccgcgtggcgatcataatcaactgatttcttcaatcaaagataaattgctgccactgggggatgacgtgacatttattccgggtcacggaccattatccacacttggttatgagcgcctgcataatcccttcctgcaagacgaaatgcccgtctggtaaaggtgcataaaaaagcccgctttcaagcgggcttcattgtttttaacgcttacagcactgccacaatcgcttcgcacagcggtgccatgttatctggtgtcatcccggccacgtttacgcgaccagaagcaacagcatatacgccaaactcttcgcgcagacgcagcacttgttcttttgtcaggccactgaaggagaacatgccgttctgtttgatgataaagctgaagtcgcgatttgcgcctttttcctgcagcgtattgacgaacaactgacgcatacgctgaatacgctggcgcatatcagtcagttcttgttcccaaatcgcacgtaacgcatcgttgctcaggatggtggcaacaacagaagcgccgtgtgctggtgggttagagtagttagcacgaatcgccgctttcatttggctgaatgcgcgttcaacagtttcactgtcagcagcaaccagagtacaagcgccaacacgctcgttgtacaggccaaagtttttagagtaggaactggcaacaatcagctccttatgcagagccgcgaaagcgcgcagtccttcagcatcttcttccagaccacgggcaaaaccctggtaagcgaagtcaaacagcggtaaccagcctttctcaacggagagttgtgccagtgtctgccattgttccagcgtagggtcgatgccggttgggttatggcagcagccatggaacagcactacgtcgccagcctgagcttcgttcaggctgttaatcagtgcatcgaagtcaagagtgtgattttccgcatcataataagcgtattcacgaacttccagacctgcagagttaaagacgctcttatggttcggccagcttgggttgctcacccacacacgcttaacgctggtattttttgccaggaaatcggcagccacgcgtagtgcgccagtgccacccggagtctgtgccgtgcgagcacgtttgtcattgatcagggcgctacctttaccaaacagcagttcctgagtgcagcgaccaaattcagggatgccgtcaatgccgaggtaatttttggtggtttcattttcgagcagatactgttcagcctttttcacgctggtcagtaccggggttttacccgtctcatctttatagacaccaatcccgaggttaattttgccgggacgttcatcggcacgaaacagatcggccaggcccagaatcgggtcggcaggagcggcggtaatgttctcaaacatgacgaggttccattatggttacagaagggaagtccgctatcagggtaacgggagatttacaaaattccaactattactgatgaaaacgcaggctgtttttgcaagacgtgagattgctctggaaggcataaaaaaaacaggaccaaagtcctgttttttcggcatttaacaaagaggtgtgctattagaactggtaaacgatacccacagcaacggtgtcgtcagaacctacgcccagtttgttgtcagaatcgatctggttgatgatgtagtcaacataggtggacatgtttttgttgaaatagtaggttgcgcccacttcaaagtagttcaccagatcaacatcaccgataccttctacgtctttcgctttagatttggtgtaagcgatggacggacgcagaccgaaatcaaactggtattgcgcaactaacagaacgtcttgcgttttgttggcgaagccgctggtgtttgtaaatttattagtgatcggcgtagcgttacgggtttcaccgtagttcgctgccaggtagatgttgttcgcgtcatacttcagaccagtagcccactgttcagcttttttgcctttgccaagggaagactcttcctgcaggttggtacggtcagcggcaccataagcaccaacgataccaaagccttcgtattcgtagctgatagaaccgccaacaccgtcgccgttagagcggcgtgcagtgtcacgctcgtttttacccaggtactgaacagcgaagttcagaccatcaaccagaccaaagaagttggagttacgataggtagcaacgccgccaacacgaccaacgaagaaatcatcgctgtatgcagtatcaccaccaaattctggcagcatatcggtgtaacccagtgcatcataaaccacaccgtagttacggccgtaatcgaaagaaccaacgtcagcgtatttaagacccgcgaatgccagacgcgttttgttaccagtttgagcgtcagcgccctcagagttgttaccctggaagttatattcccactgaccataaccggtcagatcggaattgatttgagtttcccctttaaaaccaagacgggcataggtcatgtcgccattgccaccgtaactgttttcaccgttacccttggagaaataatgcagaccgacagctttaccgtacagatctactttgttgccatctttgttatagatttctgcagcgtttgcagtacctgctactaacagagcagggacgatcactgccagaatattgcgcttcatcattatttattaccctcatggttttttttatgacacctgccactgccgtcaataagttctgtcaataaaaatttacggaactattgatgagagtttggtgtctttatgtgtctgcaggcatctttccattcaaactaacgtttcgctaccgtgaaagtgctacaaagataaagatttagtttcaaaaagaaaaagtatgtgacaaaaagtaaaaattaaggaactttgtgaacaccgtcatatttccatagaagcgtgatgatatttacagcaatttttatctatttatatgattttcttatatttaaattaactaaacggaaattttgtttctgatggaaactttatcgaccaggcacaaaatcttctttcagacatccagaatgccaaaaatttgtatgaaaattgtgctatcagctaagaaaaaactaatccgcaataagaatgcagattattttttgtgcgtaaatgttgcagcgtaatattccgtaacaggatgatcgttatggcggggttgcaaatagattgcttgacttaacaaacagataacttgacagaaaggataaaaaaagagccagcgggcgctggctcttgaagacgctaaattagaagctggcgttacgcggagtacgtgggaacggaataacatcacgtacgttttgcacgccagttacgtaagcaatcaggcgttcaaaaccaagaccgaaacctgaatgcggaacagtaccgtagcgacgcagatcgcgataccaccagtaatcttctttgttcaggcccatttcaagcatacgctcgtccagcacgtccagacgttcttcacgctgggagccaccaatgatctcaccgatgcccggagccagaacgtccatagccgcaacggttttaccgtcttcgttaaggcgcatatagaacgctttaatatctttcggatagtttttaaccactactggtgctttaaagtgttcttccgccagataacgctcatgctcagaagagagatcgacgccccagtaaaccgggttttcaaacttcctgccgcagttttcgagaatggtcactgcgtcggtgtaatccacctgcgcgaaatcggcctcaatgaagcgttccagacgtgaaacggcatctttatctacgcgttcagcgaagaatttcatgtcgtcagcgcgttcttcgagaaccgctttgaagacatatttcagcatggcttcagccagacctgcgatatcgttcaggttagcaaacgccacttccggctccagcatccagaattccgccaggtgacggctggtgttggagttttcagcacggaaagtcgggccgaaggtataaattttggacaatgcgcaagcgtaggtttcgccgttcaactggccagatacggtcaggaaagactctttaccaaagaagtctttgtcgaaatccactttgccctgatcgttacgcggcaggttttccagatccagcgtagaaacacggaacatttcgcctgcaccttcggtatcagatgcggtaatcagtggcgttgaaacccagaagaatccctgctcgttaaagaagcgatgcagcgcctgcgccagcgtatggcgaacgcgcgcgacggcaccaatcaggtttgtgcgcggacgcaggtgagcgacttcacgcagatactcaatgctgtggcgttttgccgccatcgggtaagtgtctggatcttcaacccaaccagcaacttcaaccttgctggcctgaatttcaaattgttgcccctggcccggcgacgccacgactttacccgtcacaatgaccgagcagccggtggtcagacgcaggacgtcttcattgtaattgggcagagaattattgatgacagcctgtacaggatcaaagcaggaaccgtcataaacggcgaggaaggagatgccagcttttgaatctcggcgggtacgtacccatccgcgcacggtgacttcgctgtcaacggctacgcggccctggagtacgtcggctacaggcacaacgctcataatattctctctgttaatagtcggaaaaaataaacacttgtccacccgtaaatggggggatacctatgttacctggcatctgcaatcagacaagcagaattcgcaaatgcagcgaaagatttcggaattaaaggtaaaaaaagggagccgattagctccctgatgatattaactggcttttttaatatgcggaaggtcgaacgctttgcgcagcgcccgaacaaacgctttatcgtggcagatagttttgccagggctgtcagaaagtttcgccactggtttaccgttacactctaccaacttaatgacaatattcaggggttttacctgggggatatcgcaggtcaggcgagtcccaataccaaaacttaattgcacgcgggaagagaagtggcggtatagctcaaccgctttgcgtaaatccagattgtcagagaaaaccagcgttttactctgtggatcaattcccagcttttcataatgtgcaatggctttttcaccccattcaaccgggtcgccagagtcatggcgcaggccctgatagcgactggcgaactcgacaccgaaatcacgcaggaaagcatccatagtgatgcagtcggttaatgcaatgccaagttggtcgggatactcttccagccaggcagcaagtgcagctcgctggctgttggctagatccgggctgatttgctgatgcgcctggaaccattcgtgtgcctgtgttcccattggcgtgagggaaagccgacgcgccagatcgtagttgctggtgcccacgaaccaggattcctgttgcagacgtttcacgatggtttcttgtacttcgcgagaaaaacggcggcgggtgccaaaatccatcagatggaagcgcgacatatcaagaccggcggttaatgccgagaagtcgactaatttgttttccagcgtgtcgagggcttgcgcaacgtcggcctgcggtgagcgatagcgatgtaccatttcactgataaccgccagcaaaggaacctcccagaggatgacttcacgccacgggccgcttaaacgaatatccagcttgccattatcgttggacacggtgacttgttccgggttaaagcggaactcgcgtagccagttaagatagtcggccttaaagaaaggcagggcagagagccactgatattcatcatcctgcaggcgcaggtgctgcatcgcctgaacctgttcacgaatagcatcggcataaatacccagcagatcgtcacctcggcaacgaaactccgccgcgacatgcacatcgtaatagtgatgaaacacggcttgctgcatatgcaacttataagcatctgtatccagcaacgagtgcagaacaggagaagcgaattgtgtcataggtgcgcagtagcgtcctcgtacaggagcgtttagtacaataaacatcttcaggaactgctggagtataccttgtttcgcaatttattgaaccccgatcacaccatatgccacctttctggtcgatggcataacgcggtgtatgttataaaaatgtagcaataaaggcgtttgtacctgaaaagatgaagattctgcatagcgcgatttacgcaacaggaatagactgaacaccagactctataaaagatgctaaaggttatttatgactcaacagccacaagccaaataccgtcacgattatcgtgcgccggattaccagattactgatattgacttgacctttgacctggacgcgcaaaagacggtcgttaccgcggtcagccaggctgtccgtcatggtgcatcagatgttccgcttcgtctcaacggcgaagacctcaaactggtttctgtttatattaatgatgagccgtggaccgcctggaaagaagaagagggcgcactggtcatcagtaatttgccggagcgttttacgcttaagatcgttaatgaaattagcccggcggcgaatactgcgctggaagggctttatcagtcaggcgatgcgctttgcacccagtgtgaagccgaaggtttccgccatattacgtattatctcgaccgcccggatgtgctggcgcgttttaccaccaaaattattaccgataaaaccaaatatcccttcctgctttccaatggtaaccgcgttgcgcaaggtgaactggaaaatggacgtcattgggtacagtggcaggacccgttcccgaaaccgtgttacctgtttgcgttggtggcaggcgactttgatgtgctgcgcgacactttcaccacgcgttctggtcgcgaagtagcgctggagctgtacgtcgatcgtggcaaccttgatcgcgcgccgtgggcgatgacctcgctgaaaaactccatgaaatgggatgaagaacgcttcggcctggagtatgacctcgacatctatatgatcgtcgcggtggatttcttcaatatgggcgcaatggagaataaggggctgaatatctttaactccaaatatgtgctggcccgcaccgacaccgccaccgacaaagattacctcgatattgaacgcgttatcggccatgaatatttccataactggaccggcaaccgtgtcacctgccgcgactggttccagctcagtctgaaagaaggtttaaccgtcttccgcgatcaggaattcagctctgaccttggttcccgcgcggtaaaccgtatcaataatgtgcgcaccatgcgcggattgcagtttgcagaagacgccagcccgatggcgcacccaattcgcccggatatggtcattgaaatgaacaacttctacaccctgaccgtttacgagaagggcgcggaagtgattcgtatgatccacactctgcttggcgaagaaaatttccagaaagggatgcagctctatttcgagcgtcatgatggtagcgcagcgacctgtgacgattttgtgcaggcgatggaagatgcgtcgaatgtcgatctttcccatttccgccgttggtacagccagtccggcacgccggttgtgaccgtcaaagacgactacaatccggaaactgagcagtacaccctgaccatcagccagcgcacgccagctacaccggatcaggcagaaaaacaaccactgcatattccgtttgccatcgaactgtatgacaacgaaggcaaagtgatcccgttgcagaaaggcggtcatccggtgaattccgtgctgaacgtcacccaggcggaacagacctttgtttttgataatgtctacttccagccggtgcctgcgctgctgtgcgaattctctgcgccagtgaaactggaatataagtggagcgatcagcaactgaccttcctgatgcgtcatgcgcgtaatgatttctctcgctgggacgcggcgcaaagtttgctggcaacctacatcaagctgaacgtcgcccgtcatcagcaagggcagccgttgtctctgccggtgcatgtggctgacgctttccgcgcggtgctgctcgatgagaagattgatccggcgctggcggcagaaatcctgacgctgccttccgtcaatgaaatggcagaactgttcgatatcatcgacccgattgctattgccgaagtacgcgaagcactcactcgtactctggcgactgaactggcagatgagctgctggctatttacaacgcgaattaccagagcgagtaccgtgttgagcatgaagatattgcaaaacgcactctgcgtaatgcctgcctgcgcttcctcgcttttggtgaaacgcatctggctgatgtgctggtgagcaaacagttccacgaagcgaacaatatgaccgatgcgctggcggcgctttctgcggcggttgctgcacaactgccatgccgtgacgcgctgatgcaggagtacgacgacaagtggcatcaggatggtctggtgatggataaatggtttatcctgcaagccaccagcccggcggcgaatgtgctggagacggtacgtggtctgttgcagcatcgctcatttaccatgagcaacccgaaccgcattcgttcattgattggcgcatttgcgggcagcaacccggcagcgttccatgccgaagatggcagcggttatcagttcctggtggaaatgcttaccgacctcaacagccgtaacccgcaggtggcttcacgcctgattgagccgctgattcgcctgaaacgttacgatgccaaacgtcaggagaaaatgcgcgcggcgctggaacagttgaaagggctggaaaatctctctggcgatctgtacgagaagatcaccaaagcactggcttgataaataaccgaatggcggcaatagcgccgccattcggagaatttatccctgttttctcaggcgagtttcaaattcaccacgctgcatcacccgctgcaacacttccgcttccagctctgataatcgtaccgaccctaaccggcgcggacgggggatatccaccgtcaaatccagaccaatttttccctcttcaattaacaacacccggtcagccatcgccaccgcttcgctcacatcatgcgtcaccagcaagacggtaaagccgtgctcctgccagagtgacacaatcaaatcctgcatctcgagtcgcgttaaagcgtccagcgcaccgagtggttcatcaagcaacaataaacctggtcgatgaatcagcgcccttgccagcgccacacgttgtttctgcccgccagaaagtgcggcaggccattcccccgcgcgattctccagtcctaccgcagccagagcctgacgcgccgcatcgcgccactggcctttaaggcctaacccaacgttatcaatcaccgatttccacggcagcagacgcgcgtcctgaaacatcattcgcgtatcatcctgaatctcagccagcggtgtggtgcccgctaacacgtcgcctgcggttggcgtttccagacctgccagcaggcgcagcagggtacttttgccaccgccgctgcggcccaccaccgccacaaactgacctgccggaatatgtaaatccagttggttcaggacgatattttccgcgtaatgtttgcttactgcattgagcaacaatggtgtgccctggttcagacgagcagtattcataccgtggcctccttcaaatgataagccgggttccagcgcaaccagagacgctctaacagctgcgcgctgacgtcagcaagtttgccgagcagggcgtaaagaataatggcgactaccaccacgtccgtttgcagaaactcccgcgcattcatcgccagataaccaatgccggaattggcagaaatagtttcggcaacgatcagcgtcagccacatcaggcccaacgcaaaacgcacaccgaccataattgagggcagggcaccaggcaggatcacatggataaacagcggtatgccggataatccatagctacgtgccatctccaccagcccacggtcgatattacggatgccatgccaggtgttgatataaatggggaatagcgtaccgagcgccaccagaaagatttttgcggattcatcaatgccaaaccacaaaatcaccagcgggatcagcgccagatgcggcacgttgcgcaacatctgaattgaggtatccagcagtcgctcaccccagcgtgacagcccgctaatcagccccagaattaatcccagcgatccgccaattgaaaaaccaatcagcgcacgccaggagctgatcgccagattctgccacagttcgccgctggcagagagcgtccagaacgccatcaccactccttccggtgagggcaaaatacgcgtcgatagccagccaaccgaggaggccagttgccacaccgccacgatgcccaccggtaaaaaccagggagcaacgcgcaataaccacttcttcactggcgttgccatcatcgtgttccttagctttgcgcgacgttacgggggataaaatcattcgccaccgcttcgccttgcggattcagcggttgtggctggggaatttccgggatggcgacatccagatgtgggaacagtaactcgccgacccgatacgcttcttccagatgcgggtagcccgaaagcacaaaactgtcgatgccaagtgcagcgtattcgttgattcgcgcggcgaccgtaggaccatcgcccaccagcgccgtcccggcaccgccgcgcactaagccaacacccgcccataaattggggctgatctccagattgtcgcgcttgccgttatgtagcgccgccattcgctgttgtcctacggaatccgttcgggcgaatgcggcctgtgctttggcgatagtttcatcatcaagatgcgagattaaccgctcggcggcctgccacgcttcgtcgttggtttcacgaacaatcacatgcagacgaacaccgaaacgaattttgcgtccatgcgcggcagctttcgcccgcacttgttcgattttctcttttaccagttccggtggttcgccccaggtgaggtagagatcaacttgttctgccgccagctcctgggcgacatctgacgatccgccaaagtaaagcggaggataaggctgttgaatcggcgggaagagcagtttggctccgcgtacatgaatatgtttgccgttgaaatccacagtctcgccaagcaacaaccgccgccagacctgggtaaattctgccgaggcttcgtaacgctcgctatgatcaaggaacacgccgtcgcctgccagttcttgtggatcgctgcctgtgaccaggttaaacaacgcacgtccgttagagagacggtcaagcgtggcggcctgacgggcggcaacggtaggtgaggttacgctggggcgcagggcgacaagaaacttcagccgttgtgtcaccgggatcatcgacgccgccaccagccacgcatcttcacacgatcgccccgtcgggatcagcacaccggtatagcccagacgatccgccgcttgcgcaatttgttgcagataaccgtgatcaaccggacgtgaaccttcttccgttcccagataatgcccgtcaccgtgggtcggtaaaaaccagaacatattcagactcataattgttttccttccagttgagtgggctgccagatacgctggcgaatatcgacttttttcggcaccagacggttttcataaaacagatctgccgtttgctgctgtaaggcggcaacttcagcgctcaacggtttgatggtagtgggaggacgatgatccagatacgaggcaataaccggtgccggtaagcccatcgtttttgccagtaaagcgatgctttgttcgcgctggctgcgggttaacgcatcggcctcactaaaggttgtcagcacaccctgaataaaagcgccgtttttttctgcatacggacgagctgccagataaaacgatccagtttgattgagatcggtgccgtctttcagcacccgcacgccgccctgtaataatgcagcggagtagtagggatcccagatagcccaggcgtcaacgttaccttgctggaacgcggcgcgggcatcggcaggcgtcaggtaagtgggctgaatatccgtgaatttaagcccggcctggcgaagggctcgcagtaaaagattgtgcgaactggaacctttctgaaaggcaactttgtgacctttaagatcggctacggttttgatcgggctgttttctgccaccagaatcacttcggctttgggcttcggtggctcgacgcccacgtataccaaatcagccccggcagcctgggcaaagattggcggaatatccccggtactgccgagatcgatactgccaacgtttaacgcctccagcatctgtgggccagcggggaactcgacccaggagatttttgtttgcggatagcgtttttccagtaactggtggctttttgccagcaccataccaatactgcctttttgatagcctatacgtaacgcctctggcgaagactccgcggcaacagcaagtgtagagacgctaagtaaacccgccagcgccagtttaatgatcttacgcatgggcattacctcgcagagacagaaggtcaggaacctgaacatcgcggcggtgcaacgcctgccagaaagtttctagcgcggtatcaagacgagtttgcagatttggcgtgaactgggatttgtgttggtaatcaattacttgcgagtcatcggcaaacacgccgtgcaggatctcctgggctttcagcgtacttaaaactggcttaagggcataatcgaccgccagcagatgggccacggtgccgcctgtcgccagcggcagcaccactttgccttgcaacgcacgttctggcagcaggtcgagcagggttttcagtgcaccggaataggcggctttatacacaggcgtggcgacaatcagcccatcggcctgttgcagctgttcggtgaaggtcttgagtgccggactatcgaaacgagcataaagcagatcttccgggacgaagttttgcaaattccagtgataaacctctacatccaggccatttagtttttcccgcgcatattccagcaaggagctggagcgagaaggaaagcgaggactacccgccagggtgatgacacgcatactctctccttataaccaattgttcttgttttgttaacattgataacaattcggtcagtctgacagagggcgtccgcgagtcgaaatgatttatctgaggaagaaaagccaaaaaaagcataaaaaaagcgcaataagaaaacgtttgctatttattgccgcaggtcaattcccttttggtccgaactcgcacataatacgcccccggtttgcacaccgggaatccaggagagttcatgtactaccccttcgttcgtaaagcccttttccagctcgatccagagcgcgctcatgagtttacttttcagcaattacgccgtattacaggaacgccgtttgaagcactggtgcggcagaaagtgcctgcgaaacctgttaactgcatgggcctgacgtttaaaaatccgcttggtctggcagccggtcttgataaagacggggagtgcattgacgcgttaggcgcgatgggatttggatccatcgagatcggtaccgtcacgccacgtccccagccaggtaatgacaagccgcgtctctttcgtctggtagatgccgaaggtttgatcaaccgtatgggctttaataatcttggcgttgataacctcgtagagaacgtaaaaaaagcccattatgacggcgttctgggtattaacatcggcaaaaataaagatacgccggtggagcagggtaaagatgactatctgatttgtatggaaaaaatctatgcctatgcgggatatatcgccatcaatatttcatcgccaaataccccaggattacgcacactgcaatatggtgaagcgctggatgatctcttaactgcgattaaaaataaacaaaatgatttgcaagtgatgcaccataaatatgtgccgatcgcagtgaagatcgcgccggatctttctgaagaagaattgatccaggttgccgatagtttagttcgccataatattgatggcgttattgcaaccaataccacactcgatcgttctctggttcagggaatgaaaaattgtgatcaaaccggtggcttaagtggtcgtccgcttcagttaaaaagcaccgaaattattcgccgcttgtcacaggaattaaacggacgcttgccgattattggtgttggcggcattgactcggttatcgctgcgcgtgaaaagattgctgcgggtgcctcactggtgcaaatttattctggttttatttttaaaggcccgccgctgattaaagaaatcgttacccatatctaattatttcttcaaattcctctttataagataatcagggctttattttcagccctggttgttttatattcatcgctgttgcttatttagacattttgtacttttattgttgaggttattaagcgaagcgacaatggattgtgtcgctgcggttttataaggttggggagtggcagatgcgaattaaaccagacgataactggcgttggtattacgatgaagagcacgatcgaatgatgctcgatttagccaatggtatgctatttcgctcacgttttgcgcgcaaaatgttgactccagatgccttttctcccgcaggtttttgcgttgatgacgccgcgctctatttctcttttgaagaaaagtgccgcgattttaatttatctaaagaacaaaaagccgaactggtgctgaatgcactggtagcaattcgttatctcaaaccgcaaatgccgaaaagctggcattttgtatctcatggtgaaatgtggatgcccatgccgggcgatgcggcctacgtttggttgagcgacactcatgagcaagtgaatttactggtcgttgaatctggcgagaatgccgcgctatgtctactggcacaaccctgcgttgttattgcgggtcgcgcgatgcagttgggcgacgccattaaaatcatgaacgacaggctgaaaccgcaggttaatgttgacagcttcagcctcgaacaggcagtctaacgcgccagcttaagcgcagtcttcggtacacaactacagcaaagaatagtgccatcatcgcctattgctgatttttttagcggcgtgacttcgccttctaaaagctgaacacggcaacttccacaaatgcccgcgcggcaagaataagggatacgaattccctgattttctaattgctccagcagcacctgttggttatttccacgaaatgcctgtccctgccagtcaatatctacgtttgcgtccggttgttgcgtgatgttggcagtatcatcagcggcacctgcgccgtaaattttagctggagccgttgccagaatttccacctcatcgccaacgcgaatcacgccgctattacgggcaattaaattctgaccaaaatcgacatcgccgttatcctgagcagtacggaaagattgcagtgtttttaatggttcgcctgccggatgtttttgccctttttctgggctgacggtggtgaaaatacagcggctacaaggcttaaccacatcaaacacgacatcaccaatgcgaaccactttccagctatcttcttcccaggccgatgcaccggaaaccaccagattggggcggaattgctccatttttacactggccggacaacgttgttggagatcacgtaacgaggcctcgttagcaagaaggtaaggatagccatcagcaaatgacaggggtacagtgttgtggcgtttcacgcgccgggtcatttgtggccccacccagcgtaattgcacttcgcgggagaaaaatccacttagccatttgttgatcgcgtctggcgcaattcgcgcggtaaaatgtgtgccccaaacttcggttggtgcgtcttgtgtggcgaaatcagcaaaacgaacatatgcactactgccatctggtgcggtgagatgcaagccatcatgcacgggtgaaggagtaaaccgtaccattagcggaaactggcgagcggtaataaacgtaccgtcaggttcagtgatcataaagatgcgatcgaaggccagaccactgacatctgccagggtatgtgtaagaccaatgccgcgcatcgatttaacaggatgaataaaaagccgggttaatgtcgccacggtgcggtcctcaaatgaaaataagccctcaactttatgacatgacgcgcttattagctataatgcgcaacaattttcttagagtaaaagtgacaatatgaattctctgtttgccagtacggcccgtgggctggaagagctgttaaaaactgaactggaaaacctgggggccgttgaatgccaggtggttcagggtggggtccatttcaagggcgacacacggcttgtttaccagagcctgatgtggagccgcctggcctcgcgtattatgttgccgctgggcgagtgtaaggtttacagcgatttagacctctatctcggtgttcaggcgatcaactggacagagatgtttaatcctggcgcgaccttcgctgtccacttcagtggtttgaatgacaccatacgcaacagtcagtacggtgcgatgaaagtgaaagacgcgatcgtcgatgctttcacgcggaaaaatctgccgcgtccaaatgttgatcgcgatgccccggatatccgcgttaacgtctggctgcataaagaaaccgccagtatcgcccttgatctcagtggtgatggtttacatctgcgtggctatcgcgatcgtgctggcattgcgccgatcaaagaaaccctggcagccgctattgtgatgcgatccggctggcagccaggaacaccgctgctcgatccaatgtgtggttcaggtacgttgctgattgaagcggctatgttggcgaccgaccgcgcaccgggcttgcaccgtgggcgttggggctttagcggctggacgcagcatgatgaagctatctggcaggaagtgaaagcggaagcgcaaactcgtgcccgtaaaggcctggcggagtatagctcccatttctacggttcggacagtgacgcacgggtgattcaacgtgcgcgcactaacgcccgtcttgcggggattggtgaactgatcacctttgaggtgaacgatgtcgcgcaactggccaatccgctgccgaaagggccgtacggtacagtgttgagcaacccgccatacggtgaacgtctggacagcgaaccggcgctgattgcgctgcatagtctgctgggccgaatcatgaaaaaccagttcggtggctggaatctctctttgtttagtgcctcgccggatctgctaagctgcctgcagctgcgtgcagacaaacagtacaaggcgaaaaacggcccgctggactgcgtacagaaaaactaccatgttgccgaaagcacaccagacagcaaaccggtaatggcagcggaagactacgccaaccgtctgcgtaagaacctcaaaaaattcgagaagtgggctcgccaggaaggaattgaatgttaccgcctgtatgacgccgatctgccggaatataacgttgccgttgaccgttatgccgactgggtggtggtgcaggagtatgcgccgccaaaaactattgatgcgcacaaagcgcgtcagcgtctgttcgatattatcgctgcaaccatttcggtactggggattgcgccaaacaaactggtgctgaaaacccgtgaacgccagaagggcaaaaatcaataccagaaactgggcgagaagggcgagtttctggaagttaccgaatataacgctcacttgtgggtgaacctgacggattacctcgataccggtctgttcctcgatcaccgtatcgcccgtcgtatgctcggtcagatgagcaaaggcaaagatttcctcaacctgttctcttataccggcagcgccaccgtgcatgcgggattaggcggtgcacgcagcaccaccaccgtggatatgtcgcgtacttatctggagtgggcagaacgcaacctgcgtctgaatggcctaaccgggcgtgcgcatcgcctgattcaggccgattgcctggcgtggctgcgtgaggcaaatgaacagtttgatctgatctttatcgatccgccaaccttctctaactcaaaacgaatggaagatgcgtttgatgttcagcgcgatcatctggcgctgatgaaagatttgaaacgtctgctgcgtgcaggtgggacgatcatgttctcgaacaacaaacgcggcttccgtatggatctcgacggcctggcgaaactgggactgaaagcacaagaaattacgcaaaaaacgctctcccaggatttcgcccgtaaccgccagatccacaactgctggctgattaccgcagcctgaaaggaatagtaatgtcattaatcagtatgcatggcgcatggctgtcgttcagcgacgcgccgcttctcgataacgcagaactacatatcgaagataacgaacgtgtttgtctggtggggcgtaacggtgcaggcaaatcaacgttaatgaagatcctcaaccgtgaacaggggctggatgacggtcgcattatttatgagcaagatttgattgtagctcgtctgcaacaggatccgccgcgtaacgttgagggtagcgtttatgatttcgttgccgaaggcattgaagaacaagcggaatacctgaaacgctatcacgatatttcgcgcctggtgatgaacgacccgagcgagaaaaatctcaacgaactggcgaaggttcaggaacagctggatcaccacaacctgtggcagctggaaaaccgcatcaacgaagtgctggcgcaactgggattagatcctaatgttgcgctgtcgtcgctttccggcggctggttgcgtaaagcggcattaggacgcgcgctggtgagcaatccgcgcgtattgctgctcgacgaaccgactaaccacctggatattgaaaccatcgactggctggaagggttcctcaaaaccttcaatgggacaattattttcatttcccacgaccgttcgtttatccgcaatatggcgacgcgcattgttgatctcgatcgcggcaagctggtgacctatccagggaattacgaccagtacctgctggaaaaagaagaagccctgcgcgtggaagaattacaaaatgccgagttcgatcgcaaactggcgcaggaagaggtgtggatccgccaggggatcaaagcacgtcgtacccgtaatgaaggccgcgtacgcgccctgaaagcaatgcgtcgtgagcgtggtgaacgtcgcgaagtaatgggtaccgcaaagatgcaggtggaagaagccagccgctccggtaagatcgttttcgaaatggaggacgtttgctaccaggttgacggtaagcaactggtgaaagatttttctgcccaggttctacgcggcgacaaaattgccctgattggtccgaatgggtgcggcaaaaccacgctgctgaaactaatgctcggtcagcttcaagcagacagcgggcgtattcacgttggcaccaaactggaagtggcttatttcgatcagcaccgcgcggaactggatcccgataaaacggtgatggataaccttgccgaaggtaagcaagaggtgatggttaacggcaagccacgccacgtattgggctatttgcaggacttcctgttccatccaaaacgggcgatgacgccggtacgtgcgctttctggcggtgagcgtaaccgcttgttgttggcgcgtttgttcctcaaaccaagcaacttattgattcttgacgaaccgaccaacgatcttgatgtcgaaacgctggaactgctggaagaactgatcgacagctatcagggcacggtattgctggttagccacgatcgtcagtttgtcgataacaccgttacagaatgctggatcttcgaaggcggcggtaaaattggtcgttatgtcagcggttatcatgatgcccgtggtcagcaagaacagtatgtggcgctcaaacagcctgcggtgaaaaaaagcgaagaagccgctgcgccaaaagcagaaactgtaaaacgcagcagtagcaaactaagctataaattgcagcgcgaactggagcagctaccgcaattgcttgaagatctggaggcgaagctggaagctttacagacgcaagtggcggatgcttccttcttcagtcagccccatgagcagacacaaaaagtgctcgccgatatggctgctgcagagcaggagctggagcaagcctttgaacgctgggagtatcttgaagcgttaaaaaatggtggctgatcgcaaaatagtcgatttaaacagagacagctgacaacggtaaaattgcctgatgaactgggtttatcaggcatgaaaaccaacactttgttagtcatctgcaaaatagcgcatcattaaggagtaccaatgtgcgaacatcatcatgccgcgaagcacatcctgtgctcgcagtgtgacatgctggtggcgttaccgcgccttgagcatggtcagaaagcggcatgtccccggtgtggcacaacgttaaccgtggcgtgggatgcccctcggcagcgtcccaccgcctatgcgttggctgcactgttcatgctgttgctgtccaacttgtttccttttgtgaatatgaacgttgcaggagttaccagtgaaattacattactggaaattcccggcgtgcttttttctgaggactacgccagcctcggcacctttttcctgttgtttgtgcaactggttcccgcgttttgtctgataaccattctgttactggtgaatcgcgcggaattaccggtccgtttaaaagagcaactggcacgggtgctttttcaactcaaaacctggggaatggcggagattttcctcgcgggtgtgctggtcagtttcgttaaactgatggcttacggcagcattggggtaggcagcagctttctcccctggtgtttattttgtgtcctgcaactgcgcgcttttcagtgcgttgatcgtcgctggttatgggacgacatcgccccaatgccagaactgcgccagccgctaaaaccaggtgtcacggggatacgtcaggggctgcgttcgtgctcctgttgtacggcaatccttcctgctgatgaacccgtgtgcccgcgttgtagtaccaaagggtacgttcggcgtagaaacagcctgcagtggacactcgcgctgcttgtaacgtccatcatgctgtatcttccggctaatattttgcccatcatggtgacggatttattaggctcgaagatgccgtcgacgattctcgctggggtcattctgttatggagcgaaggctcttatcccgtcgctgcggtgatttttctggccagtattatggtgccaacgttaaagatgatcgccattgcgtggctgtgttgggatgccaaaggacacggcaagcgcgacagtgaaagaatgcatttgatttatgaagttgttgagtttgtaggccgctggtcgatgattgacgttttcgttatcgcggtgctctcggcgctggtgcgtatgggaggtttaatgagtatttatccggcaatgggtgcattaatgtttgctttagtcgtcataatgacaatgttttctgctatgacgtttgacccgcgtttgtcgtgggatcgtcaacctgaatcagagcatgaggagtcctgacagtatggaatctaataatggggaagccaaaatccagaaagtgaagaactggtctcccgtgtggatatttcctatcgtcacggcgctcattggggcctgggttcttttttatcattacagccatcagggaccggaagtgaccctgatcaccgcgaatgcggaaggaattgaaggtggcaaaaccaccattaaaagccgtagcgttgacgtcggcgtggttgaaagcgccacactggctgatgatttgacgcacgttgaaatcaaagcgcggctgaattccggtatggaaaaattgctgcataaagataccgtcttttgggtggtgaaaccgcagattggtcgagaagggattagcggcttgggaacgctactgtctggggtttatatcgaactgcagccaggcgcgaaaggcagcaaaatggataaatacgatttgttggactcgccaccgttggccccgcctgatgcgaaaggtatccgtgtgcttctcgatagcaaaaaagccgggcagctctcgccaggagatccggtgctgttccgtggctatcgggtaggttcggttgaaaccagcactttcgatacgcaaaaacgcaatatcagctatcaactgttcatcaatgcaccttatgaccgactggtgaccagcaatgttcgtttctggaaagatagtggcattgcggttgatctgacgtcagcgggaatgcgtgtggagatgggctcattgacaacgctgcttagtggcggtgtcagctttgatgtgccggaaggtctggatttagggcagccagtggcaccgaaaacagctttcgttttgtatgatgatcagaagagcattcaggattcgttgtacaccgatcacattgattatctgatgttctttaaagattcggtacgcggtctgcaaccgggagctccggtagaattccggggtattcgcctgggtaccgtaagcaaagtgccattctttgcgccgaatatgcgtcagacatttaacgatgattaccgtattccggtactgattcgtatcgagccagagcggctgaaaatgcagcttggagaaaatgcggatgttgttgagcaccttggcgaattgttgaaacgtggtttacgcggatcgctgaaaaccggaaacctggtcactggcgcactgtatgttgatctcgatttctatccaaatacgcctgcaataaccggtattcgtgaatttaatggttatcagattatcccgaccgttagcggcggtctggcgcaaatccagcaacgactgatggaagcgttggataagatcaacaaactgccattgaatccgatgattgaacaggcaaccagtacgctttctgaaagtcagcgcacaatgaaaaacctgcaaacgacgctggatagcatgaacaagatcctcgccagccagtcgatgcagcagttaccgacggatatgcagtcaacgttgcgtgaattgaatcgcagtatgcagggcttccagcctggctccgcagcctacaacaagatggtggcggatatgcagcgacttgatcaggtgttgcgagaactgcaaccggtgctgaaaacgctcaacgagaagagtaacgcgctggtatttgaagcgaaggacaaaaaagatccagagccgaagagggcgaaacaatgaaaaagtggctagtgacgattgcagcactgtggctggccggatgcagctccggcgaaattaataaaaactattaccagttacctgtggtgcagagcggtacacaaagcaccgccagccagggtaatcgcctgttatgggttgagcaggtcgctgttcctgactatctggcggggaatggtgtggtttatcaaaccagtgatgtgaagtatgtgattgccaacaacaacttgtgggccagcccattggatcaacagttgcgcaacaccctggttgccaacctgagcacgcaactgcccggctgggtggttgcctcccagcctctgggaagcgcccaggacacgctcaatgttaccgtaacggagtttaacggtcgctatgatggcaaggtcattgtcagtggtgaatggctgttgaaccaccagggacaactgatcaaacgtccgttccgtctggaaggggtgcaaactcaggatggttacgatgagatggttaaagtactggccagtgtctggagtcaggaagccgcttctattgcgcaagagataaagcgtctaccttaattataaagatttgtaaatataaccgcctccggtatgttgcctgaggcggtttttttgtctctaacgtgcggaaaaagttgttcctcttcacattttttgtacaaccgacatgcccgtgtagctcacaaatatgacagtggcgtgaattttgcgcattgacggcagttatgattcgcggtattgcttaactgtgattgcatatttagtaatcactgttttcttttccaccagaaaccagtatgagggaaacgaggcatgaagagacaaaaacgagatcgcctggaacgggcacatcaacgtggttatcaggccggcatcgccggacgctcaaaagaaatgtgtccctatcagacgctgaatcaaaggtcacaatggctgggaggctggcgagaagccatggcggacagggtagtaatggcctgattctgtctctttaaaaagaaacctccgcattgcggaggtttcgcctttatatactctgtctgattaaaatcagaatgcagacgtatcctggaacagacctactttcaggtcgttggcggtatagatcaaacgaccatcaaccagcacttcgccatcagccaggcccataatcagacgacggttaactatgcgtttaaagtgaatacgataggtcacttttttcgccgtcggcagcacctggcctgtgaatttcacttcacctacgcccagcgcgcgacctttaccttcgccgcccagccagccgaggtagaaccctaccagctgccacattgcgtccaggcccaggcatcccggcataaccggatcgccgataaagtggcatccgaagaaccacagatccggattgatatccagctctgcttcaacataccctttgtcgaagttaccacccgtttcggtcattttgaccacacggtccatcatcagcatgtttggtgctggcaattgcgggcctttagcgccaaacagttcaccgcgaccagaggcaagaaggtcttcttttgtataggattcgcgtttatctaccatgttctctgtaagccttattttattgaagcacgcaggatagctaacacgtgtacgctgaacaagtccgatcagttcggaataaaccagttcagccaacgtaatggccatggaaaacggtgacgtccttcctgttgcgatgcttgtgcgatacgttcctggatggtttgcatcagcgtcgtttggccttcgccatcccacaccagatttaataataacggcagtgcgtcagtcacatcgtctactgcccagatggtgaatttgtcttcttcaaccgctttcaccagttcactgtgaagacttaaatggcgaacgttagctgtggggataatgacaccttgtttccccgttaactcacgttgctggcaaatagcaaagaagccttcgattttctcatttaaaccaccgactggctgggcgcgaccgaactgatcgactgaacctgtgatagcgatactctgattcaccggcacatcggcgagggcgcttatcagggcgcagagttcagccatcgaggcactatcgccatccacttcactgtatgactgctcaaatgtcagcgatgctgagaaggggatctgttgctcaagctgtagttccgacatcaggaacgcttgcatgatcatcatccctttcgcatggatattgccgccaagctccgctttgcgttcgatgtcggtgaattcaccatcgccaatatgcacaacgcagctaatgcgagaaggttcgccaaaagcgcgtggatgacccggaaattcaatgaccgaaagggcgttaatttgcccgatgcgttcgccttcggtttcaatcaggatttgctcctgaaggatctcatcctgcatgcgttcagcgaggaaaccttcgcgccattcacgctgctgtagcattaagtttagctgctcgccggagaaggtgtcgccatcacacggggaggcgacctcttgacactggcggaggatccactgcgggctaagcggaagtgtttcttgttcaccagtgtagcgtgctgcttcgcggataagtaccggccaggcatccgctcccggtgctggtaagtgattatgtctggcggtaaatgtcacccagcgacaccactggcttactgactccgcatcgacaatctgcagagtatcttcaaattcgctataaatagcctgctctgaaagctctggctccatctcctggaaatcagccaatgattcgcgttcgcctaccagaatgactttcagcttcaatggcatcgaaggcacagagacggggagagggcgcgactcatcaaacgcaacccagtcaaaacgctcgcggttaacgatatttttcagccgcatccacagcagaggttgcgccagcagtgtacgcaaagagatgatgagaataccgccatttgcctgatgcaccagaccaggctgcagggtaatgtcgccattaaactgacgcaggcagccaaagagttgctctgcttctacccagtcggcagcgacaacttgcgttaaagtcgcaaaattatcatctgcactcactgcgtgacgtaagcggatggtgtggccggaaacctcatagtgaccgcccaccagttggcctgcatcgctttgtagcgtacgcgcggcatcagcaataagattcagatactcagactcttccggggccttcgccagcataaaagaggaggatgctcgcgtatgcagcaactgctccagcgcaaattgcagtcgcggttgagtatcactgaataaaggatcgttttcgtcaatcaaatgtggctgagcaaatatttcctgatagctatcggtatcaggaaccaggtcacgccatgcaagtttcgtaatggtcaaagttgatgttttttagtctgttgtcaaagccgcgattataccgtaaccggcactgcagcacacgtagaaagcaacgacaatactcctggcatgggcgttaaagctcacaggatggagattcttttcttcactggcctaaaaagctgatattctgtaaagagttacacggtaacattgagatcgctatgaaatatcaacaacttgaaaatcttgaaagcggttggaaatggaagtatctggtgaagaagcaccgcgaaggggagttaatcacccgttacatagaagccagtgccgcccaggaagccgtcgatgagttgctctcgctggaaaatgaacccgtgctggtaaatggttggattgacaagcatatgaatccggaactggtcaatcgcatgaagcagaccattcgggccagacggaagcgccattttaatgcagaacaccagcatacgcgcaaaaaatcgatcgatctggaatttatcgtctggcaacgtctggctggccttgcgcagcgtcgcggtaaaacgctttctgaaacgattgttcagctgattgaagatgcggaaaacaaagagaaatacgcgaataaaatgtcttctttgaagcaggatctgcaggcattgctgggtaaggaataactgtcaaaagtcagttcaatttactaaaggcgaaaaaaaaaccccgcagctgcggggtttttctaccagacgagaacttaagcctgcggctgagttacaacgtctttgatgcctttaacttcgatctctacgcgacgatccggagccaggcaatcgatcagtgcagcacgctgtttcacgttgtcacaggtgttgccagtaaccgggttggattcgcccataccacgtgcggagattttgtctgccgggatacctttagagatcaggtaatcaacaacggactgagcacgacgctcggacagagcctggttataagcgtcagaaccgatgcggtcagtgtaacccagaacaactacggaaccgtctttcggatccaggttgctcagctggctgtacagctgatccagagcagcctgaccttccggtttcagggttgctttgttgaaggtgaacagaacgtcagacttcagagtgaagtgcttggtctgtacttccggtgccggagctggagccggagcaactactggagctacttcgccctgaccgaaacggtaggaaacacccaggctcagcatgccgttgtccggacgagtgccgatggtgtgtgcgtcaccgatgttgttggtccactggtattccagacgggtagcgatttcaggagtgatcgcatactcaacaccgccagcgaagaccggagaaacgccggtgtcgtggtttttaccataaacgttggatttagtgtctgcacgccataccataccacccagacgagtgtatacgtccagatcgtcagtgattgggtaacccagtttagcggtcagctgaacgccctgagctttatatgcaccgttttcaacgctgcctttgtatggcatacgacctaaccagtcataacccatttcaaagccaacatacgggttaacctggtaaccaccaaaagcaccagcgcccagttggttttcatgggtcggaccattgttgtcgatgaaaccagtgtcatggtactgggaccagcccagtttagcaccagtgtaccaggtgttatctttcggagcggcctgcgctacggtagcgaaaccagccagtgccactgcaatcgcgatagctgtctttttcattttttgcgcctcgttatcatccaaaatacgccatgaatatctccaacgagataacacggttaaatccttcaccggggatctgctcaatattaactctaccgatatcttcggcttatgccgagcacccctggcgatgtaaagtctacaacgtagttgaaaacttacaagtgtgaactccgtcaggcatatgaaaaaaaagtcttgtataaggtacgtttaatcttttttgtcagcgacaatttacagaaaaaaatcgcggaaaccgcttcagacaagcctccgcaaggaaaattagtcacgactgaaagcattggctgggcgacaaaaaaagttccaggattaatcctaaatttacttaatgatacaaattagagtgaatttttagcccggaaagttgtctcgttgcgtgagaggatgcgcttaccggacgcataataaaccccatagcgttaccttcatttgccgcatcaacaagttcagcatgctcttctgcagtcaaatcatctgccaaccaaccgatcaccacgctgtaattgcccgtgcgtaaagcgcgaaccattgactccacggtgtggcaaggggagagctggctaatctgcattactttcgttaagggtagcccagatgcctgaacccattcgcgactcagtttttgttgcggtgttaaccagagttgccagcgcgattgctgaccgagttgctgtaacaatggcaacagtagaagttgcgtcatcatgggctgatcttcgcgatagacaacttcactgataagcccggctgtagtgttttccgtagagacacgcgcaattttacttgctgcggatgagaacgacgaagaacgatgtgcatagcctgaagtgtacataatcaatccagcccctgtgagttactgtatgaatatacagtacatccagtgacgacaaagatcaaccctattttcggaaagagcctcgcaaattttgtcgttggtggcgggaaaacataaattaatcttgccccttaagaataagttgcctattttcgtagttaacggatccgttaatgtgaatcattcttttatgttatgattttaaaaggaattttatgaaaagcctctcctataagcggatctataaatcacaagaatacctggcaacgttgggcacaattgaataccgatcattgtttggtagttacagcctgaccgttgacgacacggtgtttgcgatggtttctgatggtgagttgtatcttcgggcttgtgagcaaagtgcacagtactgtgtaaaacatccgcctgtctggctgacatataaaaagtgtggccgatccgttaccctcaattactatcgagttgatgaaagtctatggcgaaatcaactgaagctggtgcgtctgtcgaaatattctctcgatgcagcgctgaaagagaaaagcacgcgcaatacccgggaaagactgaaagatttgcccaatatgtcttttcatctggaagcgattctcggggaggtggggattaaggatgtacgggcgttacgtatacttggggcaaaaatgtgttggttgcgactgcggcagcaaaacagtctggtgacagaaaagattctgtttatgcttgaaggggccattatcggtattcatgaagctgcgctcccggtggcacgccgccaggagcttgcagaatgggctgactctcttacgccaaaacaggagtttcctgcggaacttgagtaatctggcgttgcagacgaccaatctctggcagtaatgcaatcaataacccaacttgttgtacgaccagaggttctttgctgtctgcccgtggttcaagttgctgcatccgctgtttcaggccagctaatgcctgattgacgcgttcttcatcagcaggttgatgatgtagcgcgtcatcaacatagcaaactgcgtcatcaagaaacgccagaatttcaggattagttaactgctcccggtgagcaccgagggctgagatatagctggtaaacgtatggttaaggcacagcaaccgaaacgcggcttcgcgaatttgcggggtaacgttcggttcgctggacatatttgataccaccgacgccagttcagcatcacggttgtgtgcatcgcggcgggcaatacgatacgccagacggttatcacgcccctgatggtattgttccagtatggcatcgagataccggcagttggcctctgtggcgcgttcgagcattcgcggcagattgcgaaacttccagtcaggccagatgtagctcactgccgcccacgcaatggcacaaccaatcagcgtatcgattacgcgaggtaacgccacttcaaaaccttcacccagcaagttgaaacacagtagcaccaaaagtgtgatgaacatcgttgcatgggcgtattgcacgttacggaaggcaaaaaagagcacgccggtaataaccagcagcaccagctgcccttccagtgatggcacaaaccacagcacaggaataccaattgcgatacctaccagcgtaccaataatccttaacttcaggcggtggcgcgtggcgttatagtttggctggcagacaaacaaacttgtcagcaagatccaatacccgtgatgcattccggttatctgaatgatggcgtagccgaagcacaacaccagcgacattcttaccgcatgacggaagagggcggattccggcgtgaagtgacggctaagacgcagccagatatcactcaatccgtgcgggctgtcatcagcgagctcattttcgtcattattatggggcagtgcctgggcctgttctgattcaattgttgccagttgggcatcaatggcacgtaaattgttcagtaaaaatcccagtgttttgagtaaatcagcaggagcgccgttatcgcgcatccgctccagcgcagcatcaatatgcgtaaaagcgcgctcaaaatgcggatcatgttgataaggctgacgcagcaaaatacagcgtgacagttgctggcacgcctggccctgcatcgacatcagccgctgaaaacggaacagcacgtcgctgtggcgaaaatgttcacgcaatgtttgatattgaatatgagaagagctggcacgctcgtgaatatcctgtgcgacaaagtaataatgcagtgtgtgacgcgttccccgttgaccacgatcgccacgtaagcgggtcagcagcgagagtttcgtctgattcaatgtcgccatcagctgaccgttggcgagagccaaatcgtacagcggtgcctggctttcatcttcaatatcaggatcaaacatgcgcgacttgagctcaagataacgcgccagttgttcatagcaacgcgccaggttgtcctgcagcgggcggaccgggaacagcagatgaccaataagtgtcaggacgttgtaccagacggcaccggccagaagatacatcggctgctgataccagtgctcatacagtgatgttcccaacatagtgtaaatggcgatcagcaatgcaccgaaggcaattgttgcatagcgttgacccagaccgccgagcaaaatgaagccgctggtagagagcgttaagccaatcgcaaatagccagggccagggaaacagcaattctactgaggccgaggcgataaaaaagcagaacagcgtaatgatgaggttacgcaaacgtcccgccagtcggtcatcgagatcggtcagcgccgctgccaccatcccaagcgtcagcggaatcgtcagttttacatcacccagccaccacggaaacgctgtggttccacaaagcgcaataaaaatacgcgcgtaatacagccaggcgctgttccaggtatagcgtttgagcaaaggacttagcataaaggccatattagtggattattggaaacgacgacgtgcattggcttcgcgcgcagcttgcgctgtttctaccgataccacgcgacgaccgaccggccatagtgcaatagcggcaattttaaagttcgcaataccgacaggaatgccaatgatggaaatacattgtgcgatgcccgttgcaatgtgcatcaggcataaccaccagccaaagaaaatcagccagaaaatattcaataccgtaccgccagtatttagcagcacatttttgccagccgggttcagttcatcgacatgaatagcttcattgccataaggcaccagagacagtttagtgatctcccagcaggatcgtgtcagcggtaaggtaaaaatcagcacaatactgaccagagtcgccaacagccagcccagagtggtggcaaatccgccaagcacaaagttcagaatgttcaaaacggtacgcataaaacctcgctttactgtggttttcagtaatgggcggcaattgtaacgtttttttgggctggagcacgttttctctgacggttacactgataagaaataatttcgtgtggatctacagagtcatggaactgaaagcgacaacgcttggaaaacgtctggcacagcacccttacgatcgggcggtgatcctcaatgccgggattaaagtctccggcgatcgccacgaataccttattcctttcaatcaattactggcgattcactgtaagcgcggtctggtatggggcgaactggagtttgtactgccggacgaaaaagtggtgcgtctgcacggtaccgaatggggcgagacgcagcgtttttaccatcatcttgatgctcactggcggcggtggagtggcgagatgagcgaaattgcgtctggcgttttacgtcagcaactggatttgattgccacgcgcaccggagaaaataaatggctgacgcgtgagcaaacctctggtatgcggcaacaaatccgccaggctttgtcggcgttaccattgccggttaaccgactggaagaattcgataactgccgtgaggcgtggcgtaaatgtcaggcctggttgaaagacattgaaggcgctcggttgcagcataatcaggcgtataccgaagccatgcttatcgagtatgcggattttttccgccaggtcgagtcttcaccgctgaatccggcgcaggcccgggcagtcgttaatggcgagcattctttgttagtgctggctggtgcaggaagcggaaaaacgtcggtgctggtggcccgtgcaggctggttgctggcgcgtggtgaagcgtcccctgagcaaattttattgctggcgtttggtcgcaaagccgctgaagagatggacgagcgtattcgagaacgactacataccgaagacattaccgcacgcacgtttcatgcgctggcgctgcatattattcagcagggcagcaaaaaagttccgatagtcagcaaactggaaaatgataccgctgcccgtcatgaactttttattgctgagtggcgcaagcaatgcagcgaaaagaaagcgcaggcgaagggctggcggcaatggctgacggaagaaatgcagtggtcagtgccagaaggtaatttctgggatgatgaaaaattacagcgtcgtcttgcctctcgcctcgatcgctgggtaagtctgatgcggatgcacggtggtgcacaggcagaaatgattgccagtgcacccgaagagattcgcgatctgttcagtaaacgtatcaagttgatggccccgttattaaaagcctggaaaggtgcgctgaaggcagaaaatgctgtcgatttttcgggccttattcaccaggcgattgtgattctggagaaaggtcgctttatcagcccgtggaagcatattctggttgatgaatttcaggatatctcgccgcagcgtgcagcgttgttagcggcattacgcaagcaaaatagtcaaacgacgttgttcgctgttggtgatgactggcaggcgatttaccgattcagcggtgcgcaaatgtcgcttaccacggctttccatgaaaactttggtgaaggtgatcgctgtgatttagacacgacctaccgttttaacagtcgtatcggtgaggtggcaaacaggtttattcagcagaacccaggccagcttaaaaagccgctaaacagcttaaccaatggagacaaaaaagccgtcacgttattggatgagggtcaacttgacgctttgctggataaactctctggttatgccaaaccggaagagcgcattctgatcctggcgcgttaccatcacatgaggcctgccagcctggaaaaagcagcaacacgctggccgaagttgcaaatcgactttatgaccattcatgccagcaaagggcaacaggcggattacgtcatcatcgttggcttgcaggaggggagtgatggttttccggctgcggcgcgggagtcgattatggaagaggcgctactgccagcggttgaggatttcccggacgctgaagaacggcggttaatgtacgtggcgctgacccgggcacgccatcgggtatgggcactgtttaacaaagagaatccctctccctttgtggatatactgaaaaatctggatgtgccggtggcgagaaaaccgtaagaaacaggtggcgtttgccacctgtgcaatattacttcagacggtctgcgagataacgctgataatcggggatcagaatatcgaccgcgtcgttaaaatgcggtgactggataatgaagtctgccgttgccacgttggtggcgaccggaatgttccataccgttgccagacgcagcaaggctttcacgtcaggatcgtgcggcacggcatttagtgggtcccagaagaaaatcaatacatcaattttcccttctgagatcaatgcgccaacctgctggtcaccccccattgggccactcaacatcgcgttgacgttcatgccggtcgcgcgggaaattaagttaccggtagtgcctgttgcatacagtacgtgttgttccagtaacggttgatgccgttccacccagctcatcagcatttgtttgcagtgatcgtgtgccaccagcgcaatatgtttccgcgaaggtaaagtgcgagtcgtcagttccataatgtacatccgtagttaactttcctacagattactgtaagtacttatcgctgcaagataaagactgaaaaagcctgcgcacaggcacaaaaatctcaggaggatggttgtttttccgcccattgcaggaaagtatttcgcgtttgtgggtcagccagtttaaaccaatacttcagccgttgttctgtgagcacctgagactgcggcggaatagcatccagctcggaaacacccgaaagcagcgtactgtcatctgccatcatcgtggcaaattgcggtagtgaagcgcgtttcgcggatttgttatagcgttcaacctcgacctcataatcaatcgtttttgcagttgaggtaatggcgagaatatccagctttaccggaatcggcgtcgcatcgccatccaacaattcaaggcgcggcgcggcatcaaaatggttagcttcccgctcattctccaggcgaggcaggcgaaaattgacctggttgatgagctgggtattaaaactaaccaccagtggaggggagatatagagccgttcttcactattggaaagatgaatcgtcttctcaacgcgaaacactaactgatgcggtccattgtccagttcaatgctgtccgcaccacgcagcagagagctggaaaccttcttaccgtcgagtaccagaagatcgacatcggtagaaagccgcagcgtggtggcaaaaacggataccggcaaacataatgcaatcaaggtggtcacgatgccggttttcatagatagctcctgttaaaagaccgcccgaataataatgtgtcaaaatttttctttaatcatacttactaacatatagacatatttcccgcttttgctctcattcattcgtattagctgcatggttggcatgtcggctttgtcgtacactttgttaaacagtctggaggaaataatgaaagaaaccgatattgcaggcattttaacgtccactcacaccattgcgctggtgggggcaagcgacaaacccgatcgtcccagctatcgcgtgatgaaatatctactcgaccaggggtatcacgtcattcctgtttcgccaaaagttgccggcaaaacactgctgggccagcaggggtatggcacgctggcagacgttccagaaaaagtcgatatggtcgatgttttccgtaattcagaagcggcgtggggcgtggcgcaggaagctatcgccattggtgcgaaaaccctctggatgcaactgggggtgattaatgagcaagcggcagtgctggcgcgtgatgcagggctaaacgtggtgatggatcgctgcccggcgattgagatccctcgtctgggcctggcaaaataaaaaatacccggaaggcgaaaaccttccgggtatgtttatgaggattagttacgcagacgcggcgcctggagttgtttgcggatggtctgcgccagctcatccatggatggctgttcaggatgttcatcctgcaattcgctacttagctgggcttcagccaggtaggtatgaaccggtaggccgttatcatcctccatcaccacgtgataccacggagcggcgcgaagctcgtcattcaccgccagctcatcaggcgacggttcagagagcgaataaaccgggtcgatatccacgaccactccgagataacctaacagggaatggcggacctgctggccgataccgaatttgctggcaatcatagtcacctcccgggaaatctttacctttgatataagggtaaaattccacatttcaagttacatgacgcgacaggcaaaccctttcagatatagcccttccgggtaggtagcgatcaccggatgatcggctgcctgacggaactgctctataaattgtacatcacgaccggcatcaattgcggcatccgcgatgattttctgaaataaatcgctggtcatcagaccggaacaggagaaagtcaggagaataccgccttcattcagcaactgaatcgccagcatgttgatgtctttataaccacgacacgcgcccatcaactggcttttattctcaacaaacttcggcgggtccatcacgataacatcaaatttttcaccgcgatcgcgataagtacgcagcaatttaaagacatcatcacggacaaactctgccttgctcagatccagtttgttcagctcaacgttctgccgtgcaatatccagcgcttcgtgggaggtatcaacgctgacaacctggctgcaaccgcccatcaatgccgatacggcgaaaccaccggtataggaaaaacagttaagtacgcgtttattttcgacgtagcggcgggtagccaggcggctgtcacgctggtccaggtagtagcccgttttgtgtccgtgctgaatatccaccagcagtttcatgccgtgttcttcaatcggcagcagggcaggcggcaactcgccggtgatggggccctgagtcagctccatcccttcttttttacgtaccgcgacgtcgctgcgatcgtaaatagcacattccgggtacagcgtttgcagggcactaattaatgccgcgcgctgatactctgcgccagcactcagcagttgcagcaccagaaaattaccgaaacgatcgatagtaatacccggcaggccatcagattctccggcgattaaacgatagctgtcgaggccatctttttgcgccagccagtcacgccatttttgtgcttgctgtaaacggcgggtaaaaaaagcaatgtcgatagactcagacgggtcaaacgtccagacgcgcgcccggatttgcgaagctggcgaataagcgccgcgtgctaaccattttccctgatgatcaacaatatcgatggtttcaccgaggctggctttaccttccatgcgggcaacggccccggaaaagacccacggatggcgacgaagtaatgatttttcgcgccctttggctaacactaaacgtacactcataatttacttttctgtcgatgcaaagaaatgggcgtcattgtccggagttttccatggatttgcaacgcgtccattaaggataaggagagcagcaatgtcgaaagtctgcataattgcctgggtttacgggcgagttcagggcgtaggattccgctacaccacgcagtacgaagcgaaaaaactgggactaaccgggtacgccaaaaatcttgacgatggcagcgtggaagtggttgcctgcggtgacgaagggcaggtggaaaaattaatacagtggttaaaaagtggcggcccgcgttcagcgcgtgtggaacgggtgcttagcgagccgcatcatccctccggggagttaacggattttcgtatccgttaaatgcattttaccggtttaggcaggccagcaattttggtggcttgctttgccggacctttcgggaacagtcggtacagatagcggctgttacctttttcttcgccaaatttattcgccatcgcttttaccagcatacgaatcgccggagaagtattgaattccagatagaaatcacgcacaaaacgcaccacttcccagtgttctggcgacagcgcaatcccttcgttctctgcaatcaccaccgccagtggttcactccactggctgctttctttgagatagccttcggtatccgtttctatctctttaccttcgaagatcagcataattctttactaccttaatcagactggcggcagtgtaacaaaaaacaaagccccgcataaagcgaggctcggtaagtaaccctgggcgagattaatcgcggctggcgaagcccagaatgctcagcaggctgacgaagatgttgtacagcgaaacatacaggctaaccgtggcacgaatatagttcgtttcaccgccatgaatgatgttgctggtttcaaacaaaatagcgccagaggagatcagaatgaagaccgcgctgatcgccagatgcagagcaggcagttgcaggaagatattagcaaccataccaatcagcaccaccacaatacccgccatcagcataccgccgaggaacgacatatctttgcgggtggtcagcacatatgcggagcagcagaagaacactaacgccgttccgcccagtgccatagcgattacgtcacccattccggcagacagataggtattcagaattggtccgaggatataacccagaaaaccggtaaaggcgaatgcggagataatcccggtcggcttattcgccgttttataggtcaggaacatcaaaccatacatacccaccagcgtcagaatcagacccggagatggcagcatcagcaccgtactggcagttgcggtaatcgccgaaaaggccagcgtcaggctcagcagaaaataggtattacgcagcaccttatgggtgctaagcagcgatgtacggtcatgtgaagaactaacaatacgatccattgagtcactctctatgacagatgtaattaattaagcagcataatgataatgcgtaagggcacccagaagttttacccatctttacgcatttgatctggaacaggtttaacagcggattatcaggtcattaagcaaatataacgccctgagaatttcgacaggcaaaagaaaaaggggttagcatttagctaaccccttatcttatttggcggaagcgcagagattcgaactctggaaccctttcgggtcgccggttttcaagaccgaagaaaaacaaatgaaaatcagtgtaatacgtgaatctgctgaaaatttaattaaatttaacaccaagaaaaatcaaggtgttaggaagttgctcatagctagtataccaagtatttttgccagaaaattttctgtattgcctacttgctaaccacgagcggcagatccagtgttggtgtgatttttgttttacgatcgtaaatcaacacctgattttctgttttatgcccgctgaaaatttgtttgtcgcgactgctgccttcgtaatctgagatccccttggcttttatgtcgtgaaaattgcacccgaacggaacgccaactttttgctcggctgagcgtttagcctgattccaccagttgttcagcgttttagctatgactttcccgcctttggttgtattgatcacatattcgcatgtacaggaagatacatttcgggctaactggatcgctgtacgtaatcgcggtgaccattccttgatttgtttggtgccggttttgttttgctcaatgtagatccctttatccataatatcctgccatttcaactcaagcacatcaccgagccttgccgcacagagataggaaatctccattgcaatgcgtaactgtggaattgcttccgcatatatcgctgcatactgttcatcggtgatgtaaacagtgcgggctttaagagagaattttctgactcctttacatgggttattcttcacgtatccacgctcatatccccacccgtatactcgactcaggcttgccagttcatgatttgcctgggtcttgctctcaagccctcgtttatccatgaaaattcttacctgctcagttttgacattatcagcaagcacttttccgaataccatcagcaacgccttctgatgttgtcgataatctttttgggttcggggggccagttctgtaaatgcaggggagtccataaacatgtgccataatttagctacggtcattatgttgtggagttttgctttttccagttcataattttgccagactttagctacgctggttttccgcactcttcctagccctatagttcttgtacttccttctggtttccacacgtaactgtaaccattcgatctaacccgcggtggcagtacattatcttttttattttttcttggtcttcccattgttcagtgcctcaaaatcgggttcagcagaaaccagttcagatgtttttggcatcgttgtcagtccgtgtggaatatccctgcgtagaactattggttcgtttttaggaccgattacaaatgggatgccgtgcagtcttaactggtgttgctgttttgtgtatcgctcgtatttcgtgatctctttaatctctgctggagatagagttaattcgtacatgtggtcacgtgcctttacagcatgaccgccgccactatagctggtgggcggcgatatgggttgaacattaaaaatcagcctgactcgggatcagtttttgccagatagctgaaacgtattttgcctgataacgggcgtcatcaagtgcattatggcgctcaccttcgaatggggtagcagttctggcatcgaagtctatggctttccccagctcaacgattgtgcgtacatcgcgatcgttgtagtaacgccacgggcaggggatcccctgccgttcgtatgaacggcgcaaaatcgtgttgtcgaagttggctccatttccccagacctgaacaaaaaattcaccggagttttcgtcgataaattcccgcaattgtaacagtgcatcatctaacgggatttcatcggtcataatggcagattgcgcttcgcgtgattgcttaagccaccatttaatggtgtcccgatcaatgaccccgccagcagtttccagatcgatagtcttactaaattccggtcccatatctccggtttgcggatcgaaaaatattgcacctattgagatgatcggggcatcaggattttttcccatggtttcaaggtcaatcatcagatggtgccacaacctgctggtggatgtgataacgtgatgaccgttcaccgtaattaagggatctgccgtctcgccagtttcactatcgctggcgtgatcctgagcgctgccagcattctccttgtgtggatgttcagcgccttccatttcctccggatcatcttcctgaacttcaacctgatactcttcatcgaatgtttcctggtatgttgcgtcgcccatcaccgcgccacaatcagggcagttgccgccgccggtctgaccgcaggcggtgcagatcttttccggttcctgttgcactactggttcaggttgtttcgtttctggctcgttttgtaacgcatttgggctgttttgttccgctttctggtcgttctgttccgattcttgctggttctggtctacagaatcgcgggtttcaatcccctttacccatttcggatcattcgggtcgctaatccctgcaacaaattctccgcgagaggcagcaagcaacttatcggcgtcaggctggctgatactggctgcctgcataattttgtttacttcgtcagcggtaacttttaccaggtctggttgtgcggtcgtgtcagatgcatcagtattttgttgtgaacctgtgtatgtgccgtttttgcgtgcgaagtattcctcttttgtgatttccgtagctcccaaggctagtgctttttccagaccagaaagtttgtttgcgcgaccgtatttttcgccatccttgtcggtgaagaggaagtagaacggcccctcacgctctacagatggttcgacttccactttgcattcggttttttcgttgcccggaattgccgtttccactgcatcagtttctggtactggcgacgggagagtatcagttgcgctctgatttcttccttcatcttcaaacacgccctttgtagtcaggtattcagtaatgtatttgttcagtgccacagggtctttgtgaatgtcgatcggacgttcacggacaaggccaaaaatagtctggcggtcgtagcgaagggcatcaggctgtttgcgcattgatgccgagatacgcttccagtcttcgcggtcgttgtcgataacttcattttttgcccagcgatggatgctgccgtcaatgtttccggcatccacatcaccaggccagagagcgtaggccagttcgtcatccagtgttttccatgtctgcttgtattcgcgatgaatggcagcaatgaccgggctgatttttcctgttgaattttcactgtgctgttgattggttctggcgcgggcgagatcaacaacagacgtgtattttccggtttccttgcgttcaccttcgcgacgttttttccagatgcgcatctctgcctgaatttcgggccatttagcaccaggaatacatttatgcttaacccacccaatggcgtgcaacttaagctccggatacatggcgttaacttctggcattttcatcaacgcttcaacgatatgtccgtcgaatgttgccatgtcttcctgcaacaattcctgtgcgctaataaccatatcaacggtgatgttttcacatgtgtcgaacttaaccatgacagcgttctgtacttcaggggccagcttgtcaaaagtgacgttcatcggatcggattcagtctcaaccgggacaaaggaagcagactcctcatcccagcggttttcctgcatatattcagcatcccaggaatcgagggcagggcggggtataccgggtttatcctcgcagacaagaaatttataagcgcagtcctgagcagccggataatgctccaggaattgccagtgaaattttgcgcgggcgcgacgttcatcaccggcttcaatggcagtggctacagcgacggcaccttcttcctttattgcctgttcgtccggaatggcggcgcaaataaagactttactcattttgttttacctcattacagatttcagggtgaacgaatccctgccattgctggcatttttaatccgttggtatggcgttaatatggctggcgggttatccagccggtatttcgttattcaggttcagcgatactttttttaacgggaggcattcaccggggattttttgttcgtcccttacctgaatgcaggatgacttactgtcataaattccggtaatcacattttgtggctcacccgttataagaaaaacggtcatcaccagtgcaaatgctgaagtcactgctgttctccgataataccaagttcaagaagggcaattctggaaagtatggaattatcattgagaagataaggttcatattttctcatcttaatggcatcttccgtaaactcccggttactgagcagaacaccaatatcaaaacaaccttcagacgtattaacgtttggtaataacgtttccattatcgcgtcctcaacaatgaattttgtgatgcggtgcctggtgcctccaggtgacgttaaccagttaacaattaacgccggatacagagcattcccgttacgcccgtaaaagaccgcttgttttaactgttccgcgtgcgctgagccgcattcaccgcatcacaaaattcactttaaaaagggcggcagagcagtcacggagtaaaactgataccgccaaatgtcaccagaaaattgataacagagggcgttgtagcggggttgtcacttaagcgtatggtcaacctgacaacccggtgcattttctggagcaatggaggaaaccccagccatacttaccgccgcgccatttcgcggattgccacaaccggaagcgcacggtcgacgaaaatttaacgacaggctatctatgaaccagctacctcgccgtgcgctttcgcgttatggtctgacttttcagggaaatatcctttcagtaaactgtcagtgccggattcttatccgtgtccggcgcacgaccacacgctgtcacgagaggtctccattctcaaccagtaacctcaatggaggataaaatgtcagagcaggagttaaaacttggtgcatgttattgtgttctcaaggagctggtacacatgcttccatctactcagtatcaacagttagttggcaatttaaatcagcgaatcgaagctatgttaaaatctgatggttttaataacgtagaaacgctgatgctaaaaagatatcttgatggattaatcagataacatttttttacggcgttcatattcgttaatatttatgaagcctgttgccagaagcagttcgttaatttcatggttgtttggctgtttctggctctttgaactgggatcttccacttctttttctgcaaattgttttgctgtatcctctgtgccatggatatttaaagctgtatctgaaaacagcccagtaaacgcatcgcgcacattacgagccatattatcagtgtctttttttgttaccgattccaattcaagttcgttcagacgatgacgaagtgtgtgtgctgcaatctcctggattgaaggaggtaaatctttaaattccatcgtcaacctcatcagtcagtgtttctggttaaccagcgacgcgcgccagcttcagttttaaacgttttgcttctggtatacgtcatcgcggtaaacgtaccgtcctggttggggaacacgccacataccagagattcgctgttgccaagatcgatagtatccatgctgacctcatttccccttaacgccggggtagcggaacaaaaacctgctgcatagttattaaagttgaaccctgccgtcatgttcttacgcctcgggctggctacttaccccctgaccactgcctggtaactcgaagtattgccctgcgttctgtggggagggtgggtgatgaataaacaatagcactgctattttattctgtaaatagtaatgctattgttttttggaggtaagaaaaaaaaaccacccgaaggtggttgttggtaggaatgattaacagcttttgtttggatactgccttcgtgagtgaactacatttacgatctcgatgttagatgctgttactcggtaaagtattatgtagttaggatgggtcactatctcacgaaggcctagagctctttcgcttggtggatacaggtaagggtgttcagtaagtgacaaaactgatgtttcaatgcgtatttttagtctacgtgcagcgggagggttttccttggcaatataggctacgatctgacgcaaatcatcacgcgcagaaggtagccataaaatgggcagcattactcactcctgttcgtcgaagctatttgcgcaataaggttttccatttcagccattacttcgtcatgcggaattgcaggacgggggtctgcgaggcttgctgccactttggtgcgtaaccattcgttatagctgttttcttgttcgattgtttcaaattctgaaattatcggggaaaggactgtactcatgttctaacctcctcagattaggcgcgaagacctttttgcgcctctagccaccgcgcaacggtttcttcaattgattcttttttctccttcatttccttaagcattttctctttgtcttcttttgggaaagccctgaacgtctggatcaaatctcgctctataggttctatattaaacggaagttcgttttccgattgttccatctctgcgggtaaagcgacaacattatcctgctgcagttcttgggggtacatccttacaattcgtaacaagtctgccatatctggtctaattgactcaggcggaacttgtagcaacccagcgaacttgataacagcctctagatttaaaggtgtctgaccatttagataatggcttactgccccttgtgtcgaaaaacccagaatttctgccgcacgctcttgggttaacccaagttgagtttttttcgtcgtccagatttctttcagtctctgggcggcttgcaggtcgatctctgacaggggttttcttttcataccttcaattctaataagattattaatctctttgaaatagcagtgctatttacttttaaaaataacaatgctattaatattcatggtcacataacatgaggtgaacaatgaatcttggagaatatttgcatcattcccgtataacccagaaagattttgctgaaattgttggggtaacccaagggatggtaagccatgttattactggacgggcgaaacttacgggggggaaagttttacgctggtgtgaagcaacagggtgggtagtgaccccgcacgagattgatagcagtacttaccccaacccaaccgatggcatacctgttgactatcaggctaacacacaacccgcgctgggagttgattcatgaaaatcaaacatgaacacatccgcatggcgatgaatgcctgggcatatcctgatggtgagaaagtgcctgcagctgaaatagcccggacttatttcgaacttgggatgacgttcccggaactgtacgacgacagccatccggaagccctggcccgtaatacccagaaaattttccgctgggtggagaaggatacgcctgatgctgttgaaaaaattcaggcgctgttaccggcgatcgaaaaggcgatgccgcctttgctggtggcccgtatgcgcagtcacagttctgagtattaccgggagattgtcgaacggcgggatcggctggtgaaggatgtcgacgattttgttgcgtcagcggtcgttttgtatgaccagataaatcgcggcggcccggcagggaatgctgtggtgatgcactaaaagcacggtgttcgggggttttatgagcagcaagcttcatggtcttgtctgggaagggtgcgccttcaccggcatgatcttatccagggtggcggttatggcccgtcttgcagactacagcaatgacgagggcgtgtcatggcctgccattgaaactatccggcgtcagatcggtgcaagaagtgaatccacagtgaaatcggctattgcagaactggcgaaagagggctggctgacgaaggaagagcgtaaggtcggtgggcgtaatgtaagcaatatctatcggcttaatgtggaaaaactcgaagcagctgcggcggcggcgcgtgagtcatataaaccgaaaagaaaaattagcccggcaaaaaatgacccgttaacagttgacccgtcaaatattgacccctcaacggttgacccgtcaaattttgatggatcaactgttgataaaaaactgccgattaggggggcgatgattgaccccgatccgtcagtattaaaacctgaaccgtcagataaaagatcttcttgtccggacgcttcgcaaccggacccgcagacggctgaacaggattttttaacccgacaccctgacgcggttgtgttcagtgcgaaaaaacgccagtggggaagtcaggaagatttggtgtgcgcacagtggatctggggacgaatcgtgagtctttacgagcaggcggccagcgatgatggcgagatcactagaccgaaagaacccaactggacagcatgggccaatgacgttcgcacaatgcggatgctggatggcagaactcacagacaaatttgtgaaatgtttgggcgtctccagcgggattcgttctgggtaaaaaacatcatgagtccggcaaaactccgggaaaaatgggatgaactggttatccgcctggggcgttcgcctgcgcagcgttgcgtgaatcacatttctgaaccggacactgaaataccgccgggattcagggggtgacgtgtcatgaaaaacattgcggcagttggggttcttgaacgtattcgcagacttgcaccacagggggcggttccaccgtaccggacggtggaggagtggcgggaatggcaacttgctgaaggacgaaaacgcagcgaggagattaaccgccagaatcgccagttgcgggtggaaaaaatcctgaatcgttcgggcatccagcctctgcacagcaaatgctcgtttgcaaattatcaggtgcagaacgacgggcaaaaatacgcgctgagccaggccaaatccatagctgacgaactgatgaccgggtgcacgaattttgtgttcagcggtaaaaccggcaccgggaaaaatcaccttgcagcggcgatgggcaaccggctgatggtgaaggggcgcagcgtgattatcgtcaccgtgtctgacgtcatgagcgtgttgcatgacagctacgacaacggcaaatccggggaaaaatttttacaggagctttgcggggttgatttgctggtcctggatgaaataggcgttcagcgggagacgaaaaacgagcaggtggtattgcaccagataattgatcgccggacagcatcactgtgcagtgtcgggatgttaacaaacctgaatcatgccgcaatgagtacgcttcttggtgagaggattatggaccgcatgaccatgaacggtggtcgatgggtgacgtttaactgggatagctggcgtccaaatgtcagcaatatgagggttgtgaagtaattttgtccggaggaaattttaatggaaaccgtatctgacgcactgaaagcactgaaaaaagcctcttcacatgtggtggcagctcgccttggaatcagtcgtgaagaggctgtcaacgagctgtgggaactcaaaagaaatggcgtcgttgataaaactggtcacacctggtttctggctggcgaaggtgaatcccgggtaaccgaagagcggccagtaaaatctgaagcacaggatatgctgaccggggaggtcgaacaaaaagttaccgcagacatgatgattgagtttatcggtcaggatggggctaaaacgtgtgaggaactggcgggtaagttcggtgtcagtactcgcaaggttgcttccacgctggcggtggtaaccgcaacggggcggctggcacgcgttaatcagaacggtaaatttcgttactgcatgccgggcgataatttaccagcagagccgaaagccgcgctggtaacggaaagtgatggtaaggcctttcctcagccagcaggtgctgcgttaccagtccgggaagccgcaacacaggaagaaattaaaacagaaactgtggcggacattgtgcagccgttgccatcgtttaccgaaacgcaagcagatgagctgatttttccgtcccttcgcagggcaaacctggcgctgcgcagggcgaaaagtgatgttcagaagtgggagcgagtctgcgccgcgctgcgggagctgaacaagcaccgggatattgttcgacagattactgattcttcccgccgtgttgtatcggaaaagtgattgccggaggcgcttatggcaaaagtatttacacaagaagagcgggaaaaaattaaagggcaggttgttgaacttgtacgtctgagcggtcgcgagacgttgcggcaactggaagccaagacaggtacgacaagatatctgatgagtgttctcgccagagagctggttgccagtggcgatgtatacaactctggttacgggttattcccgcctgaacaggcgcgtaaggactggcaaaacgcccgcaaaaaactctcaagggcaaatctgaagaaaccatctgtggttgatcctgaccttatctggtcattaccagacggagaaatacgccgctacgacaggcgtcaaaacataatctgtagcgagtgccggaagagtgaagttatgcagcgcatattgtcgttttatcagggggatgttcggtatttattgaagtgacgagattaaagtgcattagttcagatgcaaattgacattttgtggcacagggtagagctagcgtggttgtccgctttgtgccagaagcggacatagcaggtgccagatgcatttgttattcttcattgaattgagcagtatccttaacaggaactctgaatacataaatgaagatgaaaaacatgtctgaagtgttgacccaagaaaagcttatttttgttgcccagagactaaaggccctcgcgcagtcaggcctgacctattcaaaagacgtctttgacaaggaacgctatgaagccttgcgtgaaattgccgctggactgctgagttcgcagtttgatattagccgcaatgatttgtttcatgtatcggaaacgggttacgcgacgcccaaaacagatgtgcgtgcgtttatcctgcgtaataatcgtattctgatggtgaaagaggctgcagatggattatggagtcttcctggcggatgggcagatgttggagatacaccttctgaagctgtgcgtcgagaggtcgaagaagaaaccggattaaaagtcagagtgactaaactattgggagtttgggatcgtaatcttcacggccatccgcctttaccctggcatgtttacaagctgatttttctctgtgaagaagtaggtggcagcctgtcaatcagccatgagtcactcgatgctgatttttttgatgtcaacgacctgcctgaattgtcgctttcaagaattgtgcctgagcagattgctgtcagcctgagagtagcgaaaggtgatgaaaaaacatggtttgattaactttcttctgcaaccattaaggaatggcaatgatattcaacgctaagggttttttattcgatatggacggtacgctggttgattcaacagccgtagtggaaagcgtctggagagatttttgtgcagaatacggtcttgatactcaggctgtgattgcttacgcacacgggcggcaaacgattgatacactgacgcattttattggtgcaggtgagaaaaccaataaaatcgcggcctcactcgaagaggttgaaatcaacacgacagaaggcgttactgaagtaaagggggccgctgcactcttatcaaaactgccaccggatagctgggcacttgtcacttctgcaggcagaatgcttgccgaaaacaggatgaaagcggctaatctccccttacccatagtaatggtgtgtgcagaagatgtaatgacgggaaaaccaagtcccgagggttacatcaaagcagctttggctttgggccttgagcctggtgaatgcgtggtatttgaggatgcatctgcgggtataaaagcagggctggcaagtggagcttcggtaatagctgttcagcctgacgctctgggatcatctgaagcccatgccgtcagcgaactgtctgacattatggtcaagatttccggagaacgtttcaatatcatctgtggttaatcacgttacacaatacgcatcaatggacgctgagtagttcgcgagttttaaacttccaacgtccgcttttcgctcaaagcggactagaaggttagcttgcgtcggacttggcgtatttaaagaagtgctggtggtgactggttgttgtgttccatttctacagaacaaaatcacagaaactatacccaatagttgtattgaatcactgacgagacagcctcatatttatcaggactggtgtacgtccaatacaggaggttgtggtgctggttctcaaatgtgcgctggctattgctgctgtaatggcaatttattgccttgctgttgttcttatggatcgcctttctgattgatttcatattggcgaggtgacgggagttaagtagaatggctgcgggtgcttgaggctatctgtctcaggcatgaacaccaaaggcagatagagaaaagccccagttaacattacgcgtcctgcaagacgcttaacattaatctgaggccatatctatgctctacacacgtaggttagcctcttacgtgccgaaaggcaaggagaagcaggctatgaagcagcaaaaggcgatgctaatcgccctgatcgtcatctgtttaaccgtcatagtgacggcactggtaacgaggaaagacctctgcgaggtacgaatccgaaccggccagacggaggtcgctgtcttcacagcttacgaacctgaggagtaagagaccaggcgagggagaaatccctcgccacctctgatgagtcaggcatcctcaacgcacccgcacttaacccgcttcggcgggttttgttttttcctggcattctggtttacaattcgcacgtcagcctgaacaactggcacctgctgcgccagcagagaaaacagatggcgcacgataccaaattttacaattcggataactctgccgcccctgccagcaggcacgggcggcgttctcatgcattcaaatctgactggtatcagcacgacccctgcaccgaagaacaggctgaatggctgattcagtgttaccgcaggcgcggatacgaggttaagaaagccctcagtctcgattatcgtcactggataatctccgtcaggcttccttactccgaacgcccaccgcgtccgtcccgcacattccagcaacgcatctggaggtaacgtgcgggtattacttcgacctgttctggtaccggaactcgggctggtgatcgttaagccgggccgtgaatccatgccggtattccacaatacccgggtactggtggagccggaaccgaaaagcatgcgtaatctgccgtccggggtcgttcctgccgttcgccagccgctggcggaggataaatcattactgccatttttcagcgacgaacgagtgattcgtgctgctggtggcgctggcgcattgtctgactggttactgcgccatgttaaatcctgccagtggccacacggcgattatcaccacagtgaaaccgtcattcaccgttatggtaccggcgcaatggtgttgtgctggcactgcgacaaccagttgcgtgaccagacctccgaatcacttgagcaacttgctcaccgaaacttgtcagcatggatgattgacgtcattcgtcacgcaatgaatggcacacaggagcgtgaattatcgctggctgaattatcctggtgggcggcctgcaatcaggtggtggatgcactacctgaggcagtagcgcgtcgttcgctgggattaccagcggaaaaaatccgctccgtataccgtgagagtgacatcgtaccgggagaacagacagccatcagcatactgaagcagcgcacaaaaaatattgcgctgccacttcacgtccaccagcaacaaaatccaccacagaaaaaaacggttgtcagtatcgccgttgatccggagtctcctgaatcgttcatgaggcgacctaaacgttgccgttgggttaatgagaaatacacgcgctgggtaaagacacagccgtgtgcgtgttgtggtaagcctgctgacgatccgcatcacctgattggtcatggtcaggggggaatggggacaaaggcccacgatattttcacgctaccgttgtgccgggagcaccacaacgaacttcatgcagacccgctggagtttgagaaaaagtacggctctcagattgagttaatttttcgttttcttgatcacgcctttgcaactggcgtgcttgggtaaaagaggtgactgatgctcatagatttggttttaccttacccgccgacggtgaacacttactggcgacgccgtggcagcacatattttatctcggaggagggaaagcgttatcgccgggctgtggcgcttattgttcgccagcagcggctgaaattaagcctgtccggaaggctggcgataaaggtgattgcagagccaccggataagcgtcgtcgcgacctggacaacattctgaaagcaccgctggatgcgctgacgcatgcgggagtgctcattgatgacgagcagtttgatgaaatcaatattgtacgtggtcagccagtatctggtggacggctgggtgtgaagatttacaaaattgagagtgagtgagcgtaaatatgatatatccggaaattacaggcaaaagcggcgaacatttacgcctgaacacgctggaagcagtctggatccaggggaaattacggatgtgggggcggtggtcgtatatcggtgggggtaaatccggaaatatgtttaaccggttactggtttcgaaaaagctgacgaaaacagcagttaatgaggttttacgcagaatgaagaaatccgggctggaaaaaccggaacttgaggcattttttcgggatatgaccagagggaagcagaagagctggttgtcacattgtacagacacagaggcgttgattattgatcgcgttatcagtgaggtgcttggggaatatcccggactaatcaatattctccggcaaaggtacgaaggacggggaatgagcaaactgaaaatggccgaaaggttaaatgcagatcatcctgagtggacgttggttacgtgcagacgccgaattgatcagtggttggggatatctgaatttatgttacatgcccccatgcgtatggcttttgttacagagaaaaaaatgttgcaaactgatcaataaactgcttcaatccgtataagcttcgcaaggctgtatcgcgaggcgaaatgcaagtttttttcgcacaaggaagccaccggaaggtggtttttttgtgtccgtaatatacagcagcgcaataaattcgctggtggttattaataccgttctttcagcttgctggctttttcgacaagagttattggtgtgtcacgttaaccggaaaagggaaaaagacatgctgaaacagcaggatatgaccgaaaccgccagagtggtgtttaatgaattaagcgtcaccgaaccggcgacagtcggggagattgcacagaatacgtacctttcacgcgaacgctgtcagttaatactgacccagcttgttatggcggggctggcagactatcagttcggttgttacagacgccttcagtcctgaaggcttttttatttgtggtaaatgggcggctggtgggtgttaggggcactcaccagccatctgctcatgcgtccggatcacaagcaaacctcaggcccactgctttgcgcaaaagcagaatgagcctatcagagacaggcttaatgatccatgtttaacactgtaaaaatatccagttgtgagttaatcaacgccgactgcctggaatttatccggtcgttccccgaaaattctgttgacctgatagtcacggacccgccgtactttaaagtgaagcctgagggctgggataaccagtggaagggcgacgatgattacctgaaatggctggaccagtgtcttgcgcagttctggcgggtgctgaaacctgccggaagtctttacctgttctgtggccatcgcctggcatctgatatcgaaatcatgatgcgtgaacgcttcagtgtgctgaaccatattatctgggcgaagccgtccggacgctggaacgggtgcaacaaggaaagcctgagggcgtatttccccgccacagagcgcattctgttcgcggaacattatcaggggccgtatcgcccgaaagatgccgggtatgaggcgaagggcagggcactgaaacagcatgtgatggctccgctgattgcttactttcgtgatgcgcgtgctgccctggggataacggcaaaacagatagtggatgccacaggaaagaaaaacatggtgtcgcactggttcagtgccggtcagtggcagctaccgaacgaaagcgattatctgaaattacaggcgctgtttgcccgggtggcagaagagaagcatcagcgcggtgaactggaaaagccccaccaccagctgctggagacgtatacttcactgaaccggcagtatgcggaactgcagagtgaatataagcatctgcggcggtattttggcgtaactgcgcaggtgccgtacacggatgtgtggacgcataaaccggtgcagtactatcccgggaaacatccgtgcgaaaaaccggcagaaatgctgcagcagataatcagtgcgagcagtcgtccgggtgacctggttgcagatttcttcatggggtcgggttcgacagtcaaagctgcgatggcgctggggcgtcgtgcaactggcgttgagctggagactgaacgttttgagcagacggtcagggaagtacaggatttagtcagtcagaatggatgatattgcaggattagttacgtaccgttattatcctgcgcccggccctttagctcagtggtgagagcgagcgactcataatcgccaggtcgctggttcaaatccagcaagggccaccatatcacataccgccattagctcatcgggatagagcgccagccttcggagctggctgcgcggggttcgagtcctcgatggcggtccattatcagcatcatgcgttgttagctcagccggacagagcaattgccttctaagcaatcggtcactggttcgaatccagtacaacgcgccacacttattttttctgtctcactttggtggacctgtttgttgctaaaaaaggaagcatcaggtggttagccgggtatcagtcatgccccgaaaattttaaatgtctcacaattcagtcagttgacagttgcctgtcagactgagtatttgttaaaagaaactggcatggtgaatccccctgtgcggaggggcatatcagcgacaggtggttggttatatcccttatctggtgcgggttcaggtgctgatactgaactcaccgggaggcacccggcatcatgctgtatacagagattaggcatatatccaggctcctcatcgcaggagcctttttacatgcaaaaaaagcccgcgccgggagacgcgggcagcaaggaataaacaacaaaacgtgaagtaatcaatttttcagctggcgaataatacccgacagtaatcactctgcgcaactgcgcggcctttttcgtattgcgggctgtagtcttccttctgtcattgtcctgtaacttccggacttcagcccgccccttatctgactcacaacattatcccgaccgggaggattcatggcatttaaacactatgacgtggtcagggcggcgtcgccgtcagaccttgcggagcgactgactcaaaaactgaaggaggggtggcagccatttggcagtccggtggccatcacgccctataccctgatgcaggccattgcggcggaaggtgatgtcaccacaccggtggtggtgcaaccgtcgggtgatggtggcgctgttatcagcaccaccagcgaaccggaatattactttgtcattgcgctggccgggcagtccaactcgatgtcttttggcgaggggctgccgctgccggatacgtatgatcgtcctgacccgcgtattaagcaactggcgcgtcgcagcacggtgacaccgggcggtgcggcctgtgcatataacgacattattcctgcagaccattgtctgcatgatgtgcaggacgtgagtaatctgaatcacccgaaagcagacctcaataaagggcagtatggctgtgtggggcatgccctgcatgtggccaaaaaactgctgccgtttatgcctgcccgtgcggggatccttcttgtcccgtgtggacgtggcgattcgggatttactgcgggagcagagggcgcgtttaatgaggcgtcgggtgcgacagcgggctcttccctgtgggggggggataaaccgttgtatcgtgacctggtcagcagaacgcgtgcagccctgaagaaaaatccgaaaaacgtgctgttgtcggtgatctggatgcagggggaaaaagatgtcagttcggggagacatgcagagcacaatgcactttttcttgccatggtaaataaataccgtgcagacctggcagatattgcagaccagtgtattggcgggacaacgtccggcgtcccgtggatttgcggtgacaccacgtacgactggaaggcgaagtatgcagtgcagtatgaggcggtttacggaggctataaaggcaaggcggcgcagaatattcactttgtgccgttgatgacggatgagcatggtgcgaatgtgccgacaaacgagccgtcagaagatccggacattatcacggcgggatactatggtgccgcgtcacgcagtaatggtaactggacgacagccgatcgtaaaacgcacttcagctcctgggcgcgaagaggcattgtttcagatcggctggcaggagagatactggtgcgagccgggcgtttgctgccgttcctgagcgggcagtctgcaccgctggcgaccacgccagcctccacgggggatgcacagtctggctctgcgggtcagacgcaacagcagggtgcaggtacttctgcaggcggtcatactgaagccgtaacaagaatggtggccggatatgatgcgaacagtggcagtggtgtatggacagagcagcagtggaatgcgtccggtggtaaaggcactgtgacggatgacagtggcaggaaggcgctgcgactggaaaaacagccgggtaaactgacctcctggaagatgttccgtactgttgcggtggaggaggcaaaaaatcttctcagtaagggaggtgaaattgccgtgcggtttaagatcccggagggtgtcgaactggttaacggtcagtttgtctttggtctgtactggccggtgtcgcagtgggcgtcaggcgcgacagcaaacagcatgctggcgtccttcttccttcagacggatgcatcaaatctgaatctgatgtaccacaagggggagtcgaatgcgcaactgggcacatttggggcatttgaccataactggcatacagttgttttccgctttgcgggaaataacagcgaaaaagtggtgccggtgattgatgatgcagagcagtctgcgtttgacctggtgatgtggacaaatgatggctttacagcagatacgctgacgctgacagatatcacgggggcaaaagcgacgtatccgatactgcttgatacggtcacagtcaaagttaacgaaagccgggcatcatcataaccggcaaaaaaaaccgccagcggcaggaacggaagctggcggaggtaatcccaatggagaatgtaaagaaaagatgctttcgtatatcggttttttaaatgaaaacagttctcattgtcaaccataacggtaagaaactatgacatttgttcatcaggtgatgctgtacttctgtacggcggtctgtgtgctgtatcttctttcgggtgggtacagggcagtgcgcgatttctggcgcaggcagattgataaaagggccgcagagaaaatcagcgccagtcagtcagccggagcaaaaacagaagccccactcattccggaacaaccttcttaataacccctttcaacgagaaaatcctatgtcagaaataaaatcgctggtcactgctgaggcagtgaaggaagtcctgcgctctgaagaagtccggagcgcactgaaacagcaacttcggcagaaccttgaggcgcgtcttgatgcagaagtggattcaattctggatgaattgcttggtgcacagccggaaccatccccggaactgcttccggaaccacaggcggaagatgtcaccacggaaaatggtgatattcagccggagtcaccggtgacggatatgacagacacacagccagaatcgggcacaatgctgtaacggtgagtcagggtcatcagtaaagagctggtggcccttttgttgttgtgagcttccgagtacgggagacggggtatgtaccagatggaaaaaatcacaacaggtgtgtcatacaccacgtcagcggtgggaacgggctactggttcctgcagttgctggacagggtttccccgtctcagtgggcggcaataggcgtgctggggagtctgctgtttggtctgctgacatatctgactaacctgtatttcaaaatcagagaggaccgtcgtaaggcagcgcggggagagtaaggcgatgaataaacaatacaaactggttgttaaagggataaataattacccggataagattactgttactgtggcactggaaattggtgggtatccgtcactgttgttgccaaatgtggcgattagtcttgaccgtactgaaggtgccacgctggaattttacgaagctgaggcgaaaaaacaggcgaagcagtttttcatggatattgctgccgctttatgtgaaggggatgagcagtcgccggaaaagcgccccataattttagaggcgcaggatgtgttgataacctacagaggaaaactaccgggaataattactggttctctgaagacgccaccgacggcattgcggtcagaaaacgatgatattgaatcacgcattgaaaaactggagtgctatatcgctgaattgaaaaaaagcaccccaacaaaaaatgaggtgcttgcagcagatgaaatgaaagaaactattcttgatcgcgcggcgcatctaagctgcgcttcacggttgaaagagcatcttcagcggcctgaagaaaaacgccgcgatgagcagttcgcggcgttttacgattattgcattgaagttactcgcaggaattttgtgaaggcttttgaggagagtaaatctcttcagtaagcttaatggcggacgctgcaattaattcaggaaggtccgcaaggtcatctgtcagtgggaatgatgaaaaatcggcggcagttctgttaagaattgctttaactaattccttttcctcatccggcaacacgttgattagagctacgactgcttgcctgagtgcgattaaatcagcaaaagtttgttttggtagatttggataatccatagtcacctctgtgtttatcagattgacataccctggccagtgcccaccactggcggggtgaaggcttaacatatccagggattcggaaccgataaatcctgataaatatccatgaacgcaaaaatcaaatacggcctgtcggctgccgttctggcgctgattgccgcaggggcttctgcgcctgaaattctcgaccagtttctggatgaaaaggaaggtaaccacaccacggcataccgtgatggtgcaggtatctggaccatctgccgtggtgccatcatggtggatggcaaacctgtcgttccgggcatgaagttgtcgaaggaaaaatgcgaccaggttaacgccattgagcgtgataaggcgctggcgtgggtggagaaaaacatcagagtgccgctgaccgaaccccagaaagcggggatcgcgtcattctgtccgtacaacattggtcccggtaagtgtttcccgtcgacgttttacagacgaattaatgctggtgatcgcaggggagcatgcgaagcgattcgctggtggattaaggacggtggcagagactgccgtattcgctcaaataactgttacggtcaggtattccgtcgtgaccaggagagcgcgctggcgtgctggggaatcgacagataagcagaatattttgctgaaaaatgcggtttgctcacacggacggataacacgaaatcctgcgaactgacaaaaactaagtgaataaaagtaaaaaccccgtttgttggctgcaagcggggttttgtgtttctgaccttggataaggcaagggagaacatggaaaagtataaacgaattctgttgaggttgactatgaaaaacggccttgaactgaaagcgcctgtaactgatgacatcagcagagcactggcttttgccattaagtgggtggcggtcggtgttgctgtgtccccgatgctgtatgggctggcaaaactggtcattgcgttgaaatcgtgaagggaggattaagcatgtcagacaaactcataacgctggcgaagatcctctgtgtaattgtcggcatttcattttcactaatgctggttgctctttttctttccatggcctggatgatgttgtcttcgtcggggctgctggggtgaacataaaccgaatgctttccgcgtttatcgttattctgctggtggcctgtggagcgctgtggatggcaacagaccattaccgtgataacgcgattacctacaaagcgcagcgcgataacaaagccagtgaactgaagctggcgaacgcaaccattactgatatgcaggtgcgccagcgcgatgttgctgcgctcgatgcaaaatactcgagggaattagccgatgcgagagctgaaaatgaaacttttcgcgctgacgttgccgctggtcgtaagcgcctgcgtatcaacgccacctgtccaggtcccgtgcgtgaagccaccggcaccgcccgcgtggataatgcaaccggcccccgactggcagacaccgttacacgggattatttcaccctcagagagcggctgatgacgatgcagaagcaactggaaggggcgcaggaatatatccgtactcagtgcattaagtagtctttttattatccggaggatgtatgaagaaattactggtaaccgtaaagccttttcagggaacaattccgttccgtattttgcagcgtggtcgtgttcttgttgaaggttcgttcagtggtaaatgtacgcaattacactcccggacctttcaggtgaatgccacgaatgaagagctaaccgttgagtgtacgatgaatgccgctaaatgccgcatggtatccgctgcattacagccagtgtgttgagcgaccttattatccatgcgcggtattgtcgccgtattcctgcattaacagagaccgcagcccgacagggagactcctctgcgagagtgtgcggggataatcaaaaacgatacacaccggggtttaccgcgttaacggagcgcggcgttgtcccctcatggtcgctggtccggtgcgatggtggaagaaactggattttgttgcaactgataatcattatcattttgccgggtcctttccggcgatccgggccgttacggggcggcgacctcgcggattttcactatttatgaaaattttccgggatccatgtccggtttctctgcaagttaaccatatgaaaaatataaaaacatgctttccatgaaccggacatgcgcaaaaaatagacactaaaaccggacatgaccggttttgttgtgattgtgaggtgagagtttttgcgaggtgaggagtggctacgcagactgaagttgccaggcatttaagtctgaccgatcgccagcttcgcagattgcagaaattgccgggtgccccgatatcgaataagcgagggcaactggatctggatgcctggcgcgatttttacatatcgtatctgagaagaagtaaaaacgatgtgcctgatggcgatagcgaagacgactatgaggagaaattgcttattgccagatgggaactgacagcagaacaggctgttacacagcagttaaaaaatgaggtgtcaaaaggaaaacttattgacaccgggttctgtatttttgccctcagcaagctggcaatggcgttatccagtacgcttgattccatccctttatccatgcagcgacagtttcctgatttaacaccgcgccatcttgaccatctgaaaacccttattgcaaagggcgcaaatcagtgtgcgcgggcgggggataaattaccggatttactcgatgaatatatcagagcaacaactgaataatatgatgagtgctgtcacaacagcattacagcccctgataagggcattgccggtgacgccagttgaatgggctgatcaaaattattatctgcctaaagaatcttcatatggtgagggagaatggaaaacgctgccgttccagatcgccatcatgaacagcatggggaatgatcagatccggactgttaatctgattaaatctgcccgtgttggctatacaaagatgttgctgggagtcgccgggtattttattgagcataaatcccgaaacagtctgctttttcagcccacggattctgccgctgaagattttatgaagtctcacgtggaggcgacgattcgggacgtgccatgcctgaaagatctttccccgtggctgggacgtaaacatcgtgacaatactctcacgctgaaacgcttttcatcgggggtgggcttctggtgcctgggtggtgcggcagcaaaaaactaccgtgaaaaatccgtggatgtggtctgctatgacgaactttcctcgttcgagccggatgtcgaaaaagagggctcgccaaccctgctgggagataagcgtattgagggctctgtatggcccaaatccattcgcggctcgacgcctaaaatcaaaggcacctgccagatcgaaaaagcggccaacgagtcggcgcatttcatgcgtttttatgtgccctgcccacactgtggggaggagctgtatctgaaatttggcgatgaatccacgccttttggccttaaatgggagaaggacagccccgaaagcgttttctacctctgtgaacatcatggctgcgtgatccatcagtctgagcttgaccagagcaacgggcggtggatctgtgaaaacacggggatgtggacccgtgacggtctgacgtttttcagcgccgcggataatgaaattccgccgccgcgctccatcacattccatatctggacggcgtacagtccgttcaccacctgggtacagattgtctatgactggctggatgcactgaaagatcccaacggcctgaaaacctttgtgaacaccacgctgggcgagacctgggaagaggccgtgggcgaaaaactcgatcaccaggtactgatggataaggttgtgcgttacacggcggcggtgcctgcccgggtggtttatctgacggcgggcattgactcgcagcgaaaccgttttgagatgtatgtctggggatgggctccgggagaggaagcctttctggtggataaaatcatcattatggggcgtcccgatgaggaagagacgctgttacgtgtggatgtggcgatcaacaaaaaataccgccatgcagacggaaccgaaatgaccatttcccgtgtctgctgggacaccggggggatcgatggcgaaattgtctatcagaggtcaaaaaaacacggtgttttccgggtgctgccggtaaaaggtgcatctgtttatggcaagccggtgatcaccatgccaaaaacccgcaatcagcggggcgtgtatctgtgcgaagtggggacggacaccgcaaaagaaattctctatgcccgtatgaaagccgagcccacgcctgcggatgaagccacgtcgtatgccatccgttttcctgatgatccggagattttttcgcagacagaggcgcagcaactggtcgcggaagagcttgtggagaagtgggaaaaaggaaagatgcgtctgctgtgggataacaaaaagcggcgtaacgaagcgctggactgcctggtgtatgcctacgcggcattacgtgtgtccgtgcaacgctggcagcttgatctggctgtactggcaaaatcccgggaagaagatacgacccggccaacccttaaagaactggcagcgaagctgtccggaggagtgaatggttacagtcgctgaactgcaggcgctgcgtcaggcgcgccttgatttattaaccggtaaacgggtggtgtctgtccagaaagatggtcgcagaattgaatatacggcagcttctctggatgagcttaaccgggcgatcaatgatgcggagtcggtactggggacaacccgccgtcgccgtcgtccgctgggagtgaggttatgaaacgaacgcctgtcctgattgatgtgaacggcgttccgcttcgggagagcctcagctacaacggtggcggtgcaggatttggcgggcaaatggcagagtggttgccaccctcgcagagtgccgatgcggccctgctgcccgcgttgcgtctggggaatgcccgtgcagatgatctggtgcgcaataacggaatagcggccaatgcggtggccctgcataaggatcacattgtcgggcatatgtttctgattagctaccgcccgaactggcgctggctggggatgcgggagaccgcggcaaaaagttttgtcgatgaggtggaggcggcctggtcagaatacgcagaagggatgtttggtgagatcgacgtggaagggaaacgcacgtttacggaatttatccgtgaaggtgtgggcgttcatgcgtttaacggcgaaatctttgtgcagccggtctgggatacggagagcacgcaactgtttcgtacgcgttttaaagccgtgagtccgaaacgggtggacacgccaggacacggtatcgggaaccgttttctgcgggccggtgtggaggttgatcgatatggtcgtgccgttgcgtaccatatctgtgaggatgattttcctcgctccgggagtggacgatgggaacggatcccgcgtgaacttcccaccgggcgtccggccatgctgcatattttcgagccggtggaggacgggcagacccgtggagccaatcagttttacagcgttatggaacggctgaagatgctggattccctgcaggcaacacagcttcagtcggccatagtgaaggcgatgtatgcagcgacgattgaaagtgaccttgataccgaaaaggcctttgaatatatcgccggtgcgccgcaggggcagaaggataatccgcttattaatattctggataagttctccacctggtatgacacgaatagcgtgacgctgggcggtgtcaaaattccgcaccttttccccggtgatgatctgaaacttcagaccgcgcaggattcagacaatggattttcggcgcttgaacaggcgctgctgcggtatatcgctgccggtcttggcgtttcctacgaacagttgtcccgtgattactcgaaggtcagttattcaagtgcccgcgcatccgccaatgagtcgtggcgctattttatggggcggcgaaaatttattgcgtcccggctggccacgcagatgttttcctgctggctggaagaggcacttcttcgggggattattcgtccgccacgggcacgttttgatttttatcaggcgcgttcagcctggtcacgggctgagtggattggtgccggaagaatggccattgacgggctcaaggaggttcaggaatcggtgatgcgtattgattccggactgagcacgtatgagaaagagctggcgctgatgggcgaggattatcaggacattttccgccagcaggtcagggaatctgcagagcgggaaaaagccggactctcacgtccggtgtggatagcgcaggcgtatcagcagcagatagcggagagtcgcaggccggaagaggagacaacaccacgtgagacgtaatctttcacacattattgcagcagcattcaatgaaccgctgcttctggagcccgcctatgcgcgggttttcttttgcgcgctcgggcgcgagatgggggcagcaagtctttcggtaccacaacagcaggtacagcttgatgcacccggaatgctggctgaaacggacgagtacatggccggaggtaaacgaccggcccgtgtttaccgggtggtgaacggtattgctgtactgccggtcacaggcacgctggtgcaccggctggggggtatgcggccattttccggaatgacaggctatgacggcattgtcgcctgtcttcagcaggcaatggcggatagccaggtgcggggtgtactgctggacattgacagtccgggcgggcaggccgccggtgcgtttgactgtgctgacatgatttaccgcctccgtcagcagaagccggtctgggcactgtgcaatgacacggcctgttctgcagccatgctgctggcgtcggcctgctcccgacggctggttacccagacatcccgtatcggctccattggcgtgatgatgagccatgtcagctatgccggtcatctggcgcaggccggtgtggatatcacgctgatttactcaggggcgcacaaggttgatggcaatcagtttgaagcgttgccggaagaggttcgccaggacatgcagcagcggattgatgcggcgcgccggatgtttgccgaaaaagtggcgatgtataccggtctgtctgttgatgcagtcacgggaacagaggccgccgtttttgaaggtcagtccggcattgaggccgggctggcggatgaattaatcaatgcgtcggatgccatcagcgtgatggctgcggcgctgaacacacatgatacaggaggcactatgccgcaattaactgcaacggaagctgccgcgcaggagaaccagcgagtgatggggatcctgacgtgtcaggaagcgaaaggacgtgaacaccttgccacgatgctggcaggacaacagggcatgagcgttgaacaggcccgggcgattctgaccgcggcagcaccacagcagccggtggcatccacgcagagtgaagccgatcgcattatggcgtgtgaagaggctaaaggtcgtgaacaactggcggcaacgctggcggcgatgccggagatgacggtggaaaaagcccgcccgatcctggcggcttcaccgcaggcggatgccggaccctcactccgtgatcagattatggctctggatgaggcaaaaggggctgaggcgcaggctgaaaaactggcggcgtttcccggaatgacggtggaggctgcccgcgacattctgtcctcatcgccggataaagcagaaccggtttctgcatccacaaccgccctgtttgaacatttcatggcgaaccattcaccggcagcggtgcggggtggcgtgtcacagacgtcagcagacggtgatgcggacgtgaaaatgctcatggccatgccatgaagtcagtgctgaccatcaatatgaggtttttacaatatggtaacgaaaaccatcactgaacaacgtgcagaagtacgtatttttgccggtaatgatccggctcataccgccacaggcagcagcgggatttctcaggcaacaccggctctgacgcccctgatgctggatgaagccaccgggaaactggtggtctgggacggacagaaagccggtagtgcggctggcatactggtactgccgcttgaaggcacagagacggtgctgacctattacaagtcggggacctttgcgacggaggcaatccgctggcctgacagtgtggatgaacacaaaaaggccaacgcctttgtcggcacagccctgagtcacgcggcgctgccgtaacacgttatcaggccaccgcgttggcctgactgatttctgaatgaaaggaactgatttatgggattgtttacgacccgccagttactcggttataccgaacaaaaagtgaaattccgtgcgctgtttctggagctgtttttccgccgtacggtgaatttccacaccgaagaggtgatgctggacaaaattaccggaaaaacgccggtggcagcctatgtctccccggttgttgaaggaaaagtgctgcgtcatcgcggtggtgaaacccgcgtgttacgtccgggctacgtcaagccgaaacacgaatttaattaccagcaggcggtggagcgccttcccggtgaagatccggcgcagctgaacgaccagacctaccgtcgtctgcgtatcatcaccgataacctcaaacaggaagagcacgccattgtccaggtggaagaaatgcaggcggtgaatgccgtgctgtatggcaaatacaccatggaaggagaccagttcgagaaaattgaggttgattttggcagatcgacgaagaataacatcatacagggtagcggtaaggagtggtcaaaacaggaccgtgacacgttcgacccgacatatgatatcgaccttttctgtgatcaggccagcggtcttgtgaatattgccatcatggacggtaccgtctggcgtctgctgaatggctttaagctgttccgcgaaaaactggatacccgtcgcggctcaaattcacaactcgaaacggcagtgaaagacctggggtcggtggtgtctttcaaggggtattacggtgatctggccattgtggtggcgaaaacgtcttatgtggcagaggacggtaccgaaaaacgttatctgccggagggcacgctggtcctgggaaatacggctgctgagggcatccgttgctatggtgccattcaggatgcgcaggcgttgtccgaaggtgtggtggcctcttcccgttatccgaaacactggatgaccgtgggcgatccggcccgtgaattcaccatgacgcagtccgcaccgctgatggtgctgccggatccggatgagtttgtggtggtacaggtgaaataatccgtgagcgggggcgaaatgcccccgtgtcttttttcacagggggctggatatggcaacaaaagaagaaaatcagaaacgtcttcgtgaactggctggcctgctggggcgcgaggcggatatgtcggggagtgcagcggatatcgcacagcgtgtggcagagtgggaagaggaggtttgcgcatcggaaaatgaaatcgcagatgttgatgataccgtttatgagcaggcatacaggaacaccggtgaggatgctttcggtattctggaacgtatcatgcttctgaagtgtttttacctgtgcggtgttgacgatgaaacaggtgagcctgttgagcatgttgatgctggcagagtaattctgatgcccccctcagtggcaaaagacatggtcaagagtggaatggccgtttatgcgtgattttcagaatgccttcgatgctgccctcgccggggtggacagcacgattgttgaagtgatgggactctgtgcgcagttcacctcgggggcacagcgtggtggcgaagttcagggggtttttgacgatccggagtcgctgggttttgccggtggcggggtccgtattgaaggaagcagcccgtcattatttgtgcggacggatacggttcgggctgtgcggcgtggtgacacgctgaccattaacggcgagatgttctgggtggatcgtgtttctccggatgacgggggaagctgttatctctggctcaaccgtgggcaaccacccgctgttaaccggcgacgataaacgcagggtgaaattatggcgataaaagggcttgatcaggcgattgataatctgagccgggttcgtaaaaacgccattccggcggcttcagcaatgacgattaaccgcgtggccacaacggcgattaatcagtcttcgtcacaggttgcccgggaaaccagagtgagacggaaactggtaaaggaacggtccagactgaaacgggcgacggtcagaaatccgaatgccagaattatcgttaaccgcggtgatctccctgtgattaagctggggatcaggatgctggggcgtcgcccgaacagcatacttaaagccggtcagcatcggtatcagcgggcatttattcagcgattaaaaaatggtcgctggcatgtcatgcagcgtgtggccgggaaaaaccgttaccccattgatgtggtgaaaatcccgatggcggccccactgaaacaggcatttgatgagaatgttgaccgtatccggcgtgaacgcctgcctaaagaactggcatacgcgctgaaacaacaactgaggattgcgataaaacgatgaaacacactgacattcgtgccgcagtgctggatgcactcgagcagcatgaacacggggcgacgctgtttgatggtcgccccgttgtttttgacgaagaggattttcctgcgatcgcggtttatctgacggatgcagagtataccggtgaagagctggatgcagatacctggcgggccacactgcatattgaggtgtttttaccggcacaggtaccggattcagagctcgatcagtggatggaaagccggatttacccggcgatgaccgagatcccggcactggcaggactgattaccacgatggttacgcagggctatgagtatcgtcgtgatgacgatatggcgttatggagttctgcagatctgacttattccattacatacgagatgtgaggacgatatggcaacaccaaatccccttgagccggtaaaaggtgccggtaccactctgtgggtttacaacggcaaggctgatgcttatgcaaacccgttgtcagacgatgactggcagcgactggctaaggtgaaggatctgacgccgggcgagatgacggctgaaccctacgacgataactacctggatgatgaagacgcggactggaccgcgaccgggcagggacagaaatctgcaggtgataccagttttacgctggcctggaaaccgggtgaggaaggtcagaaagggcttatcgcatggtttgaaagcggggatgtcagggcctataaaatccggttcccgaatggtacggtggatgtgttcagtggctgggtcagcagtatcggtaaggccgtgacggcgaaggaagtgatcaccagaacggtgaaagttaccaatgtgggacgcccgtcgatggctgaaaatctcactaaaattacgccggtttccggtgtgaccattaaaccggaaaccctgaccctagaaaaagggaaggcaggcacacttactgtggctgtgttgccggataatgcgtctgatccttcattaagggtgtcgaccgtgcatcgtgcggtggccacagccacgttgaaggagaacacagtgacggtaaacgcacttgagaaaggaacaacgtcggtcgtggtcatgagtgataacggtaattttgtcgctctggcgacagtaaccgttaatgtccctgccgcgtaacgggtgtttaggagaacacgcatgtttcttaaaacagaacaatttgaatataacggtgtgtctgtcacgctttcggagctgtctgcgctgcagcgtatcgagcatcttgccctgctgaaacggcgggcagaagaggctgaagccagcggcaacctgcaggtgagtgtggaagatcttgtcagaaccggcgcgtttctggtggcgatgtccctgtggcataaccatccacagaaaacgcagtcaccgtcaatgaatgaggccgtgatgcagatcgaacaggatgtgctgacgacctggccggctgatgccattgcccgggcggaagaggtggtgttacgtctgtccgggatgagcggggctgttcatgcggatactgacagcaccgaagtggcgaaaaataacgcgcttactgatgatgatttttctgcgggaaagttttcgacggcgagctgaattttgccctcagactggcgcgtgagatggggaggcctgactggcgcgccatgcttgccgggatgacatccaccgaatatgccgactggcgacatttttaccgcacgcattattttcaggatacccaactggatatgcatttttccgggctgatgtacgccgtactcagcctgtttttttgcgatccggatatgcatccctcggatttcagtctgcttgtcccccggcatgaggaagagcaggtggagaggccggatgaggacaaaatgctgatgcagaaagcggcaggacttgccggaggcgtccggttcggtggggacggagggcgcgatattttatcgtctgcggatgtggcggatgtcatggtggatgatgccgcattaatgatggcttcagcggggattccgggaggtgtgagatatgtcccagccggttggtgatcttgttattgacctgagtctggatgctgtccgtttcgatgagcagatgagccgggtaaggcgtcatttttcaggtctggataccgacgccagaaaaaccgccagtgctgttgaacagggcctgagccgccaggcgctggccgcacaaaaagccgggatttccgtcgggcagtataaagcagccatgcgtaccctgcccgcacagtttacggatatcgccacgcagcttgccggtggtcagaatccctggctcatcctgctgcaacagggcggtcaggtgaaggactccttcggcgggatgatccccatgttcagggggcttgccggtgcgatcaccctgccgatggtcggggtcacctcgctggcggtggcgacaggtgcgctggtgtacgcctggtaccagggggattccacgctttcagaatttaataaaacgctggtcctttccggcaatcaggccggactgactgccgatcgtatgctgacgctctcaagagccgggcaggcagcagggctgacgtttaaccaggcgagagagtcactggcagccctggtgaatgccggtgtgcgtggtggtgaacagtttgatgccattaaccagagtgtcgcgcgttttgcgtctgcatccggtgtggaggtggataaagtcgctgaagccttcgggaagctgaccactgacccgacgtcgggactgatggcgatggcgcgccagttccgtaacgtgacggcagagcagattgcgtatgttgctcagttgcagcgttccggcgatgaagccggggcattgcaggcggcgaacgaggccgcaacgaaagggtttgatgaccagacccgccgcctgaaagagaacatgggcacgctggagacctgggcagacaggacagcgcgggcgttcaaatccatgtgggatgcggtgctggatattggtcgtcctgataccgcgcaggagatgctgattaaggcagaggctgcgtttaagaaagcagacgacatctggaatctgcgcaaggatgattattttgttaacgatgaagcgcgggcgcgttactgggatgatcgtgaaaaggcccgtcttgcgcttgaagccgcccgaaagaaggctgagcagcagactcaacaggacaaaaatgcgcagcggcagagcgataccgaagcgtcacggctgaaatataccgaagaggcgcagaaggcttacgaacggctgcagacgccgctggagaaatataccgcccgtcaggaagaactgaacaaggcactgaaagacgggaaaatcctgcaggcggattacaacacgctgatggcggcggcgaaaaaggattatgaagcgacgctgaaaaagccgaaacagtccggcgtgaaggtgtctgcgggcgatcgtcaggaagacagtgctcatgctgccctgctgacgcttcaggcagaactccggacgctggagaagcatgccggagcgaatgagaaaatcagccagcagcgccgggatttgtggaaggcggagagtcagttcgcggtactggaggaggcggcgcaacgtcgccagctgtctgcacaggagaaatccctgctggcgcataaagatgagacgctggagtacaaacgccagctggctgcacttggcgacaaggttacgtatcaggagcgcctgaacgcgctggcgcagcaggcggataaattcgcacagcagcaacgggcaaaacgggccgccattgatgcgaaaagccgggggctgactgaccggcaggcagaacgggaagccacggaacagcgcctgaaggaacagtatggcgataatccgctggcgctgaataacgtcatgtcagagcagaaaaagacctgggcggctgaagaccagcttcgcgggagctggatggcaggcctgaagtccggctggggggagtgggcggaaagtgcgacggacagtttttcgcaggttaaaagtgcggccacgcagacctttgacggtattgcacagaatatggcggcgatgctgaccggcagcgaacagaactggcggggattcacccgttcggtgctgtccatgatgacagaaatcctgcttaaacaggccatggtgggcattgtcgggcgtatcggcagcgccattggtggtgctttcggtggtggtgcgtctgcctccacggggacggccattcaggctgcggcggcgaacttccatttcgcgaccgggggatttacgggaaccggtggcaaatatgagccagcggggattgtccaccgcggggagtttgtcttcacgaaggaggcgaccagccggattggtgtcggcaacctgtatcgtctgatgcgcgggtatgcggaaggtggttatgtcggcggtgccggaagtcaggcgcagatgcggcgggcggaaggtattaattttaatcagaacaatcacgtggtgattcagaacgacggtatcaacggacaggccgggccgcagctgatgaaagcggtgtatgacatggcccgcaagggggcgcaggatgagctccggctgcagttgcgtgatggcggtatgttatcagggagcgggcgatgaaaacctttcgctggaaagtgaagccggatatggaggtgaactcgcagccatcggtgcgtgaagtgcgttttggtgacgggtactcacagcgtatggcggcagggctgaatgctgacctgaaaacatacagggtgacgctttccgtgacccgggaggaggcccggcatctggaagcgttcctggcagagcacggtggctggaaggcatttttgtggaagccaccctatgcataccggcagataaaggtgacctgtgccgggtggtctgcgcgggtcgggatgttgcgcgttgagttcagcgcggagtttaagcaggtggtgaactgatgcaggatattcacgaagaaagtctgagcgagtcggttaaatcagagcagtcaccgcgggtggtactctgggaaatcgacctgacggtacagggtggtgagcggtattttttctgcaatgagctgaatgaaaaaggggagccggtgacctggcaggggcgtgaatatcaggcgtacccgattgagggcagcggctttgagatgaacggaaagggcagcagtgcccgcccgtcgctgacggtgtccaatctgtttggccttgtcaccgggatggcggaggatttgcagagtctggtgggtgccacggtggtccgtcgccgggtgtatgcgcgttttctggatgcggtgaactttgtggcaggcaatcctgaggcagacccggagcaggagctgacggaccggtgggtggtggagcagatgtcagcgctgacgtccatgacggcctcgtttgtgctggcgacaccgacggagacggacggtgcgctgtttcccggtcgcatcatgctggcgaacacctgtatgtggacctaccgctctgatgagtgtggttacacgggcggggctgtggcggatgagttcgataaacccaccacggatatccgtaaggacagatgcagcaagtgcatgcgcgggtgtgaactgcgcaggaatgtcggcaattttggcggtttcctttccatcaataaactttcgcagtaaatcctgttttatgacacagactgaatcagcgattctggcgcatgcccggcggtgtgcgcctgcggagtcgtgcggcttcgtgataagcacgccggagggggagcggtatatcccttgtgtgaatatttccgcagagccggaggcgtattttcgtatcgcaccggaagactggctgcgggcagagatgcagggggagattgtggcactggtccacagtcatcccggtggtctgccctggctgagcgaggccgaccggcggctgcagataaaaagcgcactgccctggtggctggtcagccggggtgacattcacaaattccgctgtgtgccacatctgacaggacggcgctttgagcacggggtgacggactgttacacgctgttccgggatgcttatcatctggcggggactgaaatgccggattttcatcgcgaggatgactggtggcgcaacggccagaacctgtacctggataatctggaggccacagggctgtatcaggtgccgttgtcatcagcacaaccgggcgatgtgctgctgtgctgctttggtgcttcggtaccgaaccatgccgccatttactgtggcaacggtgagctgcttcaccatctgcctgaacaactgagtaaacgggagaggtattccgaaaaatggcaacgacgaacgcattctgtctggcgtcaccgccactggcacgcatctgccttcacggggatttacaacgatttggccgccgcctcagcctgtatgtgaacacggcagcggaagccatccgggcgctgtcgttacaggtgcccggattccgccgtcagatgaacgaaggctggtaccagatacgtattgccggtgaggacacggcaccggaggcggtgtacgcccgtcttcacgaacagctgggtgagggaacggtcatccacattgtgccgcgactggccggtgccggaaagggcggactgcagattgtgctgggggcggcggccatcgtggggtcgttcatcacggccggagcctcgatggcgttatggggttcagccctggcagccggtggtttttctgccaccacgatgctgttttcacttggagccagcatgattctgggcggtgtggcccagatgctggccccgaaggcaaaaacaccggattaccgggcaacggataacggtaaacagaacacgtacttttcctcactggacaacatgattgcccagggcaacccgatgccggtgccttacggggaaatgctggttggctcccgccgtatatcccaggacatcagtacccgtgatgaaggcgggggcggaaaggtcgtggttatcgggcggcaggggtaaaaagaataaaaaaatcccgcagtgatcgcggacaggaactgcgggagagttacgaagattaagtgtaaggaattattcttatgtcacgacaaaaaaattaacgcagagaaattatacgcgccacagtcagtttgtgaaaatgtgaagatattcagaatttttattcagtcatgatacaggcatcctccggggtgcctgttgttttttgggcataaacagattcagacatcagacaggagagggggagcgagtgggtaaaggtggcggcagggcgcacacgcctcgtgaggcgaaggataatctcaaatccacgcagatgatgagcgtgattgatgcgattggtgagggacccattgaaggtccggtgaaaggcctgcagagtattctggtgaacaaaaccccgctgacggacacggacggtaatcccgtgatacacggtgtgaccgcggtctggcgcgccggggagcaggagcagacaccaccggaaggctttgagtcctccggagctgaaactgtactgggtgtggaagtgacgaaggcaaaaccggtgacacgcaccattacgtcagcgaacattgaccgcctgcgggtgaccttcggggtgcagtcactggtggagaccacgtcaaagggtgaccgtaatccgtcctctgtccgtctgctgattcagttacagcgtaacggtaactgggtgacagaaaaggatgtcaccattaacggcaagaccacctcacagttcctggcgtcggtgattctggataatctgccgccccggccctttaacatccggatggtcagggagacggcggacagcaccacggaccagctgcagaataagacgctctggtcgtcatacaccgaaatcatcgatgtgaaacagtgctacccgaacacggccattgtggggctgcaggtggatgcggagcagttcggcggccagcagatgacggtgaactaccatatccgcggtcgcatcatccaggtgccgtcaaactatgacccggaaaaatgcacgtacagtggtatctgggacggcagtctgaaaccggcatacagtaacaatccggcctggtgtctgtgggacatgctgactcacccgcgctacgggatgggaaaacgcctgggggcggcggatgtggacaagtgggcgctgtatgccatcgggcagtactgcgaccagacggtcccggatggtttcgggggcacagagccgcggatgacctttaatgcgtacctggcacaacagcgtaaggcatgggacgtgctcagtgatttctgctcggcgatgcgctgtatgccggtatggaacggccagacgctgacgttcgttcaggaccgtccgtcggatgtggtgtggccgtacaccaacagcgatgtggtggtggatgataacggcgtggggttccgctacagcttcagtgccctgaaggaccggcacacggcggtggaggtgaattacaccgacccgcagaacggctggcagacctccacggaactggtggaagacccggaagccatactgcgctacggacgcaacctgctgaagatggacgcgttcggctgtaccagccgcggtcaggcccaccgtgccgggctgtgggtgataaagaccgaactgctggaaacgcagacggttgatttcacactcgggtctcaggggctgcggcacacacccggtgacattattgaaatctgtgataatgactatgccgggaccctgaccggcggacgtgtcctgtccattgatgctgccacccgcaccctgacgctggaccgggaggtgacactgccggagaccggcacggccactgttaatctgattaacggcagcggtaagccggcgagcgtggccatcaccgcacaccccgcgcctgaccggatacaggtcagcaccctgccggatggtgtggagacatacggtgtgtggggactctccctgccgtcactgcgtcgtcgcctgttccgctgtgtctccatccgggaaaacacggacggcacctttgccatcacggcggtgcagcacgtacctgaaaaagaagccatcgtggataacggggcccgctttgagccgcagtcaggcaccctgaacagcgttatcccaccggcagtgcagcacctgacggtggaggtgagtgcagctgacggtcagtatctggcacaggcgaaatgggacacgccgcgggtggtgaagggcgtgcgcttcagtctgcgcctgaccagtggaagcggtgagaacagccgcctgctgaccaccgccatcactgccgatacggagcaccgtttcagtggcctgcctcccggggaatacaccctgacggtcagggcgattaacagctatggccagcagggcgaacccgccaccaccacgttccggattaacgcaccggcagcgcctgccggtgttgaactgacgccggggtattttcagataacggcagtcccgaaactgaccatttatgacccgacggtgcagtttgagttctggttttcggaggcaaaaattgcagacgccgcacaggtggaaacctctgcccgttatctggggacaggcagccagtggagcgtctccggcagccagattaaacccgggaaagttttctggttttacgtgcgcagcgtcaatctggtgggtaaatccgcgtttgttgaagccagtggacgggccagtgatgatgctgcgggctatctggagtttttccgggaaaagataggaaaaacacatctggcagaggcgttgtgggcagagattgacaacagcaagctgaaggacgagatggcggaaatgcagaccaccatcacagaaacccgcaatgaaatcacgcagacggtcagtaaaacgctggaggaccagagcgccaccatacagcaaatccagcgtgtgcagacggacacccgtaatgacctgaacagcatgtgggcggtgaagctgcagaagatgcaggacggacgcctttatattgccggtattggtgcaggcattgagaatacggatgaaggggtgcagagccagatactgctggcagcggaccgcgtggcattcattaacccggaaaatggtaacaccacacccgcactggtcacgcagggtggacagacctttatcaatgaggcgctgataaagacgctcaccgcccccaccattaccagcggcggcaatccccccgcattctccctgacgccggacggcaggctgacggcccgtaatgccgatatcagcgggaatatcagtgccagttccggtacgctgaataacgtgacgattgcggaagactgcaccattaatggaacgatgagcgctgaccgaatcattggtgatatcgtcaagggatacacggttgatatggggcagggcgtaatgactcagaaccagctgacttttcagaaaatgattttgctgaaagacaacatgccgtttgatcgcaagcttatgcttatggcgtattcattttccagaggtgaattcatcatgaagataaatgacaaagttgtcgttcatgccaggtcaggcaaagtcaaaaccggggagcgggaggtccagatttccaaaaacgccagcagatatgagccggtatattctgatgttggcggaagtgcgtcaggctcatggagtattcctgccggacagggtgatgtgcgggttgaaattacattcaggtatgaagcagatgtgcttttttacatgggtggttcaatacttcatgataagagtaaaattcggatccatgacccggttctgttttacctgaaatcctatacagacgattttgataccgcatcgtgacaggtggatagtgaggtatcatccatctgttcgtgattgccggaaaacgacaaaagccggacatcgtacattatccacgggtgcctttgactgacggcaccctttaacaccagccagtcacaatttatacccctgatcgcagaccgggtaaccggtactgcggttttttttatgggagaaatctatgacagtcagaatatcgggcgtgctgaaggacggcaccgggaagccggtgccgggatgcaccatagagctgaaagcgcgacgcaccacagagacagtgatagtcaccacggtggcgcaggggcagccgggggaaaccggcagttacagttttgatgtggagccggggtggtaccgggtgacgctgaacacggaagggtacgccccgtcgtatgtgggtgacattctggtgaaggcggattctgagccgggaacgctgaataaatttctgatggaacaggatgaggcgcagtattacccgaaagcgcttgcagagctggaagcggtggcagcggaaatcctgaagcgtgctgaagcgtcggcggcgagtgcagaggaagcgaagaaacgggcagagaatgcccggggaccggcgggcgagaagggggacacaggtccacagggtgccacaggggcacagggaccagccggggcaacgggggcggtcggaccaaaaggtgagccggggccaaagggagaacggggagaaacaggtccacagggaccgaagggcgataaaggtgacccgggcggaccgccggggccgaaaggtgacaccggcccacgtggagaggccggaccacccggaccacagggtccggcagggcaaaccggcccgaaaggggataaaggtgaacccggcgcaacaggtccggcaggtcccgcaggccctcggggagaaaccggccccgcaggtcctgcgggtcccgcaggcagtgtcgccagtgttccggatgccagcacatcacagaaaggtgttgtacagctgagcagcgataccaacagcgatgatgaaacaaaagcggcaaccccaaaggctgtgaaagcggtaatggcagaagtgcaggcagcaaaaacgaaggcagaagaggcagcaacccgggcagcagtccccggaccgaagggggacaggggggaacctggcgcacctggtgcagtgggtcccgcaggcccacggggaccggctggtgcagctggtcccaaaggtgatgcaggcccggcaggccccgcaggaaaggatggtaccgccggagcggaaggtaaggcaggtccggcagggccacgaggtgaaaggggaccagcgggggcacagggtgttccggggccggttggtccggcaggtcctgcgggtaaaacggggccacgaggtttgcagggagaaacaggaagacagggcccgacaggtccacagggcccgacaggtgaacccggaccacaggggccaaccggaaggctggtacccggggaaatttacagcatcggaacatacattattgccgcactaggcccgtatataaccgacatcggcagaacctatcagccaggagaaactgtatcgggttcacgccttaagcgatgcgccctaatcaaagacgaaaacggaaactatatgaaagctaacaccgatggcattgacggcaacctatcctcagttccggggtcatggatggtgtgtaatgaaattacgtcgacaaatgacaatgaaggcatcgggctgttccagcgcgcatactgacagacaggagatgacatgaatgtggaaaaaaataagcaatccgcaatgggcagataaagatcacactgctgtcaattgcatggtgaagtttgagcacattgagcaggcggttcctttcactgcaacagccagcgataccgaagcatacgggcgggatatttatgccgcttgtctgagaggagaggccggtgaaattgcagaatatgtacagccatccatcagcccggaaaaagccagagaactcaaaaccgccgggatcaacgcctggcgtaatgcgatggaagcggcgaactacacgtttgagcacaatgggcgtaaatgggactacgggaagtcaacgcagacgcgtcttgagccgtcggtggcggcagcgaaagcggggaaactgccggaggcgtttttctggacggatgcggacaataatgacgtaccgatggacgctgaaacactgattgctctgagtgctgctgcagagcaggcgatgttcaccaaagggatggaaatccacgttcgccagcgcaccatgaagaaggagctggaaaagctgaccagtgcggatgagatactggcatacagggttggctgggcacaggaataacagacaaaaagatgggggaccatcacctcccccatgaactgcgttgattatgtaattattgtgaagagaccttatctacacagataaagagtgccacggaaaagttaatcctgaaagtgataccggtctcatttccagagcatcctgttgatatggatgatttttcagatttccggaagtccgtattttgcccgtgcgcggttacatgcttcattcgcgatgccattttcgccggacattgcgaattccctgcatgtggacggacggtttttgtaaacagagcaatatgcgttttcacccggagttcccgccagagcgactgaccggaacctttccgccagcatcgtcagtttctgcccagtaaaaagagacgcggaaaatgcacaacaggcaccacacgtcatgcatggattggggttattcataattcatcggtatagcgataaatcataaagagaaaaatctatctggtatgtgttgagctaaatataccaattagtataccaagtgtatactaagagcaaaaaaagaaaggggctaccatttggtaaccccttgattgtttggcggaagcgcagagattcgaactctggaaccctttcgggtcgccggttttcaagaccggtgccttcaaccgctcggccacacttccagaatgacgcgcactataaacatcccgatgcggcgtgtaaacccctaatttgtttgtttgcctgaaaaacagccaaaagtgcattgttagcgtgaaataacagcagattgatcatttcatcaccatgaattccttctcttttactcgtttagcaaccggctaaacatcctcaccgcccggcaaaaagaaaaataggtccatttttatcgctaaaagataaatccacacagtttgtattgttttgtgcaaaagtttcactacgctttattaacaatactttctggcgacgtgcgccagtgcagaaggatgagctttcgttttcagcatctcacgtgaagcgatggtttgccttgctacagggacgtcgcttgccgaccatgtgcgcccggtgtcctgccggtgtcgcaaggagaagagacgtgcgatatgaataacgaggaaacattttaccaggccatgcggcgtcagggcgttacccggcgcagctttctcaaatattgtagtctggctgccacgtcgctgggattaggcgcgggaatggcaccaaagattgcctgggcgctggagaacaaaccgcgcattccggtggtatggatccacggtctggaatgcacctgctgtaccgaatcttttatccgctccgctcacccgctggcaaaggacgtcatcctttccctgatttccctcgattacgacgatactttgatggctgccgccggaacccaggcggaagaagtctttgaagacatcatcgcgcaatacaatggcaaatatatcctcgccgttgaaggtaatccgccgctgggcgagcaggggatgttctgtatcagcagcggacgaccgtttattgagaaactcaagcgtgccgccgctggagccagtgcgattatcgcctggggaacctgcgcgtcctggggctgcgtacaggccgcgcgacctaatccgacgcaggcaacgcctatcgacaaagtcatcaccgacaaacccattatcaaagtacctggctgcccgccgatcccggatgtgatgagcgccatcattacttacatggtgacgtttgatcgtctgccggatgtcgacagaatgggccgtccactgatgttttatggtcagcgtatccacgataaatgctatcgccgtgctcacttcgacgccggagagttcgtccagagttgggatgatgacgctgcccgcaaaggttactgtctgtacaaaatgggctgcaaagggcctaccacctataacgcctgttcctccacacgctggaacgatggcgtttccttcccgatccagtcaggtcacggctgcctgggttgtgcggaaaatggtttctgggatcgcggttcgttctacagccgcgtggtcgatattccacaaatgggtacccattccaccgccgacaccgtcggtttaaccgcgcttggcgtggtggcagcggctgttggtgtgcacgcagtcgccagcgccgttgaccagcgcagacgtcataaccagcaacctacagaaaccgaacatcagccaggcaatgaggataaacaggcatgagcactcagtacgaaactcagggatacaccatcaacaatgccggacgccgcctggtggtcgacccgattacgcgcattgaaggccacatgcgctgcgaagtgaatattaacgatcagaatgtgatcaccaatgccgtctcctgcggcaccatgtttcgcgggctggagatcatcctgcaagggcgtgacccgcgcgatgcgtgggcgttcgttgaacgtatctgcggcgtctgtactggcgtacacgccctggcttcggtttacgccatcgaagatgccatcggtattaaagtgccggataacgccaatatcatccgcaacattatgctggcaacgctctggtgccacgatcatctggtgcacttctatcagcttgccgggatggactggatcgatgtgttagatgcgctgaaagccgacccgcggaaaacctccgaactggcgcaaagcctctcctcatggccgaaatcatcccctggctatttcttcgacgtacaaaaccgcctgaagaaattcgttgaaggcgggcagttggggatcttccgcaatggctactgggggcacccgcagtacaaactgccgccagaagccaacctgatgggctttgcccactatctcgaagctctcgatttccagcgtgaaattgtcaaaatccacgcggtctttggtggtaaaaacccgcatccaaactggattgtcggcgggatgccttgcgccattaacattgacgaaagcggcgcagtcggggcggtcaatatggaacgcctgaacctggtgcagtcgatcattacccgtacggcggacttcattaacaacgtgatgatccccgacgccttagccatcggccagttcaacaaaccgtggagcgaaatcggcacgggtctttctgataaatgtgtcctcagctacggcgcattcccggatattgccaacgactttagtgagaaaagtctgctgatgcctggcggcgcggtgattaacggcgacttcaacaatgtgctgccagtggatttggttgatccgcagcaggtgcaggagtttgtcgaccacgcctggtatcgttatcccaacgatcaggtggggcgtcatccgttcgatggcattaccgacccgtggtacaaccccggcgatgtcaaaggcagcgataccaacattcagcagctgaatgaacaggaacgctactcgtggatcaaagcgccacgctggcgcggtaacgcgatggaagtggggccgctggcacgcacgttaatcgcttatcacaaaggcgatgctgcgaccgttgagtcggtcgatcgtatgatgtcggcgttgaaactgccgctttccggcatccagtcaacgttgggccgcattttgtgtcgcgcgcacgaagcgcagtgggccgcaggtaagttgcagtatttcttcgataaactgatgaccaacctgaaaaacggcaatcttgccaccgcttccacggaaaaatgggaaccagcaacctggccgacagagtgccgtggtgtcggttttaccgaagcaccgcgcggggcgttaggccactgggctgccattcgcgatggcaagattgatctctatcagtgcgtggtgccgaccacctggaacgccagcccgcgcgatcccaaagggcagattggcgcttatgaagcggcgctgatgaacaccaaaatggcgatccccgagcaaccgctggagatcctgcgtactctgcacagctttgacccgtgcctcgcctgttcaacacacgtgctgggcgacgacggtagcgagcttatctccgtgcaggtgcgttaacagcgaaggagaatcatcatgcaacagaaaagcgacaacgttgtcagtcactatgtctttgaagcacccgtgcggatatggcactggctgacagtgttatgcatggcggtgttgatggtcaccggttactttatcggcaagccgctaccttctgtcagcggcgaggcgacgtatctgttctatatgggctacatcaggttaattcacttcagcgccgggatggtttttaccgtggtcttgctgatgcggatctactgggcttttgttggcaatcgttactcccgcgagctgtttatcgtgccggtatggcgtaaaagctggtggcagggcgtgtggtatgaaatccgctggtatctgtttctggcaaaacgtccgagtgccgatataggccataaccccatcgcccaggcggcgatgttcggctatttcctgatgtcagtttttatgatcatcactggctttgcgctgtacagcgaacacagccagtacgctatttttgcgccgttccgttatgtggtggaatttttctactggacgggtggcaactcaatggacattcacagctggcatcggctggggatgtggctgattggcgcgtttgtgatcggtcatgtctacatggcgctgcgtgaagacatcatgtccgacgacacggtgatctccactatggtcaacggctaccgtagccacaaatttggcaaaataagtaacaaggagcgttcatgagcgagcaacgcgtggtggtaatggggctgggcaacctgctgtgggccgatgaaggcttcggcgtgcgggtggcggaacggctgtatgcccattaccactggcccgaggatgtggagattgtcgatggcggcacccaaggactgaacttgctggggtatgtcgaaagcgccggtcatctgttgattctcgatgccattgattacgggctggaacccggaacgctacgaacgtatgccggagaacgcattccggcttatctcagcgcgaagaaaatgagcctgcaccagaacagtttctccgaagtgctggcgctggcagatatccgcggacatctgccagcacatattgccctcgtcggtctgcaacccgcgatgctcgacgactacggcggcagcctgagcgaactggcgcgggagcaactgcccgctgcggaacaggcggcgctggcgcagctggctgcgtggggaattgtgccgcaaccggctaatgaatcgcgctgtctcaattatgactgtctgtcgatggaaaattacgaaggcgttcgcttgcgtcagtacaggatgaggctggaggaacagggatgagcaacgacacaccatttaatgcgttgtggcaacgaatgctggcacgtggctggacgccggtcagtgaatgccgtcttgacgactggcttacgcaagcgccagacggcgtggtgttattaagcagtgacccgaaacgcacgccagaagtcagcgataacccggtaatgattggcgaattactgcgcgaatttcccgactatacatggcaggtagcgattgctgatcttgagcagagcgaagccatcggcgatcgctttggcgtctttcgctttcccgccacattagtgtttaccggcggaaactatcgcggcgtgctgaatggtattcacccgtgggcggaactgataaacctgatgcgcgggcttgtcgaaccgcaacaggagcgtgcttcatgagcgaaacttttttccatctgctggggccaggaacgcaaccgaacgatgacagtttcagcatgaatccactgccgatcacctgtcgggtgaatggtgaaccgagtatggctgccctggagcaatgtgctcacagcccgcaggtgattgcgctgttaaacgagttacaacatcaactaagcgaacgccagccgccgctgggtgaggtactggcagtcgatctgttaaatctcaacgccgacgatcgtcactttatcaatacgcttctcggggaaggggaagtgtcagtgcgcattcagcaggctaacgacagtgaaagtgaaattcaggaggcgatcttctgcggattatggcgggtgcgcagacgtcacggcgaacagttgctggaagacaaactggaggctggctgcgcaccgctggcgttgtggcaggcggcaacgcaaaacgtcttgccgacagattcgctgttaccgccgcccattgatggcctgatgaatggcctaccgttggcccatgaattactggcacatgtacgtaaccccgacgcgcagccgcacagcattaatctgattcaattacccatcagcgaagctgaccggctttttctctcacgtctctgtgggccgggaaatattcagattcgtaccattggctatggcgagagctatatcaacgccacggggttacgccatgtctggcatttacgctgtacggacaccttaaaaggcccgttactggaaagttatgaaatctgcccaataccggaagtggtgctggcagcgccagaagatttggtcgactctgcgcagcggcttagcgaggtatgccagtggctggcggagggtgcaccgacgtaaaaagacggtaagtatcgctttcaggcttatgaatatcgcaatcggcgaatacctctggtcgtagagtttcaggataaagagggagatctaccattaacgggttatttttctctcttcgcctacaggagtgcgcatgtgggatgtcattgatttatcgcgctggcagtttgctctgaccgcgctgtatcactttttatttgtaccccttaccctggggctgatttttttgctggctatcatggaaaccatttacgtggtcaccggaaaaacaatctaccgcgatatgacgcgcttctggggtaagctcttcggtatcaattttgctcttggcgtggctaccggcctgacgatggagtttcagtttggtactaactggtcattttattccaactatgtgggcgatatttttggcgcaccgctggcgatggaagcattaatggccttcttcctcgaatccacctttgtcgggctgttcttcttcggctggcaacggctgaataaataccagcacctgctggtgacgtggctggtggcgttcggttcaaatctctctgcgttgtggatattgaatgccaacggttggatgcaatacccgaccggtgcgcattttgatatcgacaccctgcgtatggagatgaccagtttcagcgagctggtctttaacccggtcagccaggtgaaatttgtgcacaccgtaatggcgggatacgtgaccggggctatgtttattatggcgatcagcgcctggtatttactgcgcggacgggagcgcgatgtcgcattacgctcgtttgccatcggttccgtcttcggcactctggcgattatcggtacgctgcaactcggagacagttctgcgtatgaagtcgcgcaagtacaaccggtaaaactggcggcgatggaaggggagtggcaaacggaacctgcacctgcaccgttccatgtggttgcctggccggaacaggatcaagagcgtaacgcctttgccatcaaaattcccgcgctgctagggatcctcgccactcactcattagataaacccgtgccgggtctgaagaatttgatggctgaaacctacccacgcttgcaacgcggacgtatggcgtggctgttaatgcaggaaatatcgcaaggcaatcgtgagccgcatgtgttgcaggcattccgggagctggaaggcgacctgggttacggcatgttgctctcccgctatgcaccggatatgaatcatgtcacagccgcacagtaccaggcggcgatgcgtggcgcgatacctcaggttgcgccggtattctggagtttccgcatcatggtgggctgtggttccctgctgttactggtgatgctgattgcgcttgtccagacgctgcgtggcaaaatcgaccagcatcgctgggtgctgaaaatggcgctctggagtttgccactgccgtggattgcgattgaagccggatggtttatgaccgagtttggtcgtcagccgtgggcgatacaggacatcttaccgacatactccgcgcactccgccttaaccacaggacaactggctttctcactgatcatgatcgtagggctttacaccctgttcttaatcgccgaagtctacctgatgcagaaatatgcccgtctggggccgagcgcgatgcagagtgaacaaccgacgcagcaacaggggtaaaggagaaaatcatgtttgattatgaaacattgcgcttcatctggtggctgcttattggcgtgatcctggtggtctttatgatctccgacggatttgacatggggatcggctgtctgctgccgctggtggcgcgtaatgatgatgaacgtcggatagtgataaacagcgttggcgcgcactgggaaggtaatcaggtctggttgatcctcgcaggtggggcattatttgccgcctggcccagagtgtatgcagcggcgttttccggcttttatgtggcgatgattctggtgctgtgctcgctgttcttccgcccgctggcctttgattatcgcggaaaaatcgccgatgcacgctggcgtaaaatgtgggatgccggactggtcatcggcagtctggtgccgccggtagtcttcggtattgcattcggcaacttgctgctcggtgtgccgtttgccttcacaccgcaattacgcgtggaatatctcggcagcttctggcaactgctgacgccattccctttattgtgtggattgctcagtcttgggatggtgattttgcaaggtggcgtctggttacaactgaaagctgttggtgtgattcatctgcgttcacagctggcgaccaaacgcgccgcactactggtgatgctgtgctttttgctggcgggttactggctgtgggttggtattgatggctttgtactgctcgcccaggatgccaacggtccttccaatccgttaatgaaactggtggcagtgctacctggtgcctggatgaataatttcgtcgaatcgcccgttttgtggatcttcccgctgctggggttcttctgcccattgctgacggtgatggcgatttatcgtggtcgcccgggttggggatttttgatggcgtcattgatgcaatttggcgtgattttcacggcaggcatcacgctgttcccctttgtcatgccgtcaagcgtgagtccgatctccagcctgacgttgtgggacagcacttccagtcagctgacgctgagcattatgttggtaatcgtgctgatatttttgcccattgtgttgctctacactctctggagctactacaaaatgtgggggcgcatgacgacagaaactctccgccgtaacgaaaacgagctgtactaaggagcaggaacaatgtggtatttactttggttcgtcggcattttgttgatgtgttcgctctccacccttgtgttggtatggctggacccgcgattgaaaagttaacgaaggtaagcctgatgaggcgcattagcgtcgcatcaggcaatcaataatgtcggatatgaaaagcggaaacatatcgatgaaagcgatcttgatcccattcttatctcttctgattccgttaacaccgaaatctgcattcgctcagagtgagccggagctgaagctggaaagcgtggtgattgtcagtcgtcacggtgtgcgtgcaccaaccaaggccacgcaactgatgcaggatgtcaccccagacgcatggccaacctggccggtaaaactgggttggctgacaccgcgcggtggtgagttaatcgcttatctcggacattaccaacgccagcgtctggtggccgacggattgctggcaaaagagggctgcccgcagccaggtcaggtcgcggttattgctgatgtcgacgaacgtacccgtaaaacaggcgaagccttcgccgccgggctggcacctgactgtgcaataaccgtacatacccaggcagatacgtccagtcccgatccgttatttaatcctctaaaaactggcgtttgccaactggataacgcgaacgtgactgacgcgatcctcagtagggcaggaggggcaattgctgactttgccgggcatcggcaaacggcgtttcgcgaactggaacgggtgcttaatttcccgcaatcaaacttgtgccttaaccgtaagaaacaggacgaaagctgttcattaacgcaggcattaccatcggaactcaaggtgagcgccgacaatgtctcattaaccggtgcggtaagcctcgcatcaatgctgacggagatatttctcctgcaacaagcacagggaatgccggagccggggtggggaaggatcaccgattcacaccagtggaacaccttgctaagtctacataacgcgcaattttatttactacaacgcacgccagaggttgcccgcagtcgcgccaccccgttattggatttgatcatgacagcgttggcgccccatccaccgcaaaaacaggtgtatggtgtgacattacccacttcagtgctgtttatcgccggacacgatactaatctggcaaatctcggcggcgcactggagctcaactggacgcttccaggtcagccggataacacgccgccaggtggtgaactggtgtttgaacgctggcgtcggctcagcgataacagccagtggattcaggtttcgctggtcttccagactttacagcagatgcgtgataaaacgccgctgtcattaaatacgccgcccggagaggtgaaactgaccctggcaggatgtgaagagcgaaatgcgcagggcatgtgttcgttggccggttttacgcaaatcgtgaatgaagcacgcataccagcgtgcgctctccatcaagacaaataaacatttgccgctgttggtccacgcaggccatttacgcggcaaaattccacgcgtaatcttggtataagcacttctgcgtcgcggggagtgaatgcggaaatatggacctggacttctttacgaccgtcggaggggataatgaatcctttgccgcttttgcgatcaaaggttttgacaattcctgtcattttacgggacaaacaaattccttactgaaaatactgcgctgcactatacggggttaataaaataaagccagcgatatttaagaccgccggacggctaaaataaaatttgcttaatctcaattatcatgcgttaatagctgcgtcggtttgaaagacagacagcatacaaagtagtttactaaagcagttctcattatcaggcattatccccttcttttgagtctctcctgaacactaagtagtttctgtattaaagccctgtttgccgaaaggcccaaaatgaaggaagtaaaatatgtctaataaaatgactggtttagtaaaatggtttaacgcagataaaggttttggctttatcactcctgatgatggcagcaaagacgttttcgtccatttcactgccatccagagcaatgaattccgcacgctgaacgaaaatcagaaagttgaattttctattgagcaggggcaacgtggtcccgcggcagcgaacgttgttacgctctaaggttgccgttattactcaacatctccatttccgctgtccatgttgccatggttcacagtaccgcacatcggcattcgatgtgacggagcgaaaccctttgggtgcaaagtgcattttttgtaaatcgacgatgatcacctttgataacgtcgcgctgcaaatacgcactgaccatgcgccgctggatttcacaaaataatatcaggctccctcgtggagccttttttatatctgccttatttttcttcaatgctgtatgtatagtaagcgataacctgttgattattgaatctttcggggagatggcttataacatttcttacctgaccagggtaccgggaaccaacaccttactggcgtgttgctgtcttttaagaccagaagaggttaacagtgaatattgaagagttaaaaaaacaagccgaaacggaaatcgccgactttatcgcgcaaaaaatcgccgagctgaacaagaatacagggaaagaagtctctgaaattcgcttcaccgcacgagaaaaaatgaccgggcttgaaagttatgatgtcaaaatcaaaataatgtgattttgtgaacatcaccccgtgcgaggtgatgttccgcttgttgctaatttagtgaccaatcattggcgattgcggaattaagcgttggtacaattcctccggcaccgggctttgccatactcccgcatagattgcgtaaccaatcgccgcaaacataatccccataaccagtagcgtcattaaccatccagacaacgcaaaggcttttttatttgccgcaggtttttgcagtgaaaaggtcaatgttgaggctaccggacatgactctacgcaagtcatacagccggtacattccactgttcgtacctgaattaatttatcgaccgggatccgtgatgggcaactttttgcgcatttgccacaatcgatacaactttcggcattgcgacgaatcttaaacggcgataatagcgaaaccacgcccatcagcgcgccatatgggcaaagataacgacaccaggcatggcgaataaacaggctggcaatcagcaaaacgatcatgctgattaatgtcgcggtccccatatgacgaaagaaatcgagcattttaacgtccatcaccacgctgtagggcgacaacataaaatagtgaatcgcctgagcgggcatcaataacgcgatatagagaaaaaaactcaacagcaaatacttcacgccgcgcagaggaatatccagccagcggggaaggacaaattgccgaccaaacagtttgttaccgagatcgccgattaattccgaaagcgtaccaaccgggcataaccatgaacaaaaggcctttttgagtaatagactgatgacgataaaagcgaccaataacagcatcgcggcggcgtggacggacggtaactgacctgttgcaaggctatatttcagattcatcagaccggcaatcggtagccagccttcgatacctcccggtctggcgacaaatgtcgtactacctgccgtttcgtaatagcgcacccaataccagaacgtgatggcaatataaatattaattgccaacagtaataattgtgtcgctttacgccaggtcgtggcattgcgccagtcattccacggtaatttgccgcccgtcgtgcctggccgccgctgccagcgggttctttttttctctgccatgattttgccagtccgttaagttgcataccaaatgccactattctagttgttcttaactggctgatattgattcaaatcgcgttcaggtttttcttattaaccatgcttccagagcggcaacactgcgtgtaatttcttcgtgtggaaggggggcagataatggctgctgctccagttgtgcgcattgctggctggcgctacgcattcccagactcgagcaactgctttttagctgatgtgcggcacgctttattttctcgttatcctgactggcgcgggcaatgtcgatttcatcgagaagcggcagggcatgttgtttaaataatatcagccattcgtggatcttctccgcccccattaaatgagcatcttcattgagttgcgatacatccagcggttgatcatttttgacttgcagttggagatagtgcgccagtaattgagcgagcacttcacgcggcaccggtttagggataatcccgcgaaatagcgaactggtacgctggcgcagtgtttcgtcgatgacatgagcgctaaagccaatcaaaaccagcgacggatattgctgtgccagttgccgggcaagcgtaatgccgtcgatatccggcagatcaaaatccaccagtgcgacagcaaatggttcactattttgcagtgtctctaaagcctgcgcggcatttcctacggcaacgacctgcgccccactgctgttcaacatctcaacggtaatccgctgggttagcgggttatcttcaattaacagcaaacgtaaaccgtccagacgcaccgcctgattgactgttttgggcacgggtgcagtggcaatacgtaacggcaagcgtaaacaaaaacagcttccaacctccggcgtgctggtggcgctcagttcgccacccatcgcctgggccagacggctactgatagtcagccccagcccggtgccgccgcgtttgccgctaacctgaacaaatggctggaagatttcagccagtttcgcgggatcaataccgcagccgctgtcttccacttcgaccagccattgttcgccatcagtgcgactacgcagaataatgtgcccttcgtcggtgaaacgcagggcgttgctcaacaggttggtaatgacctgacgaatacgccgcggatcgcccattaacgcagtcggtacatcgtcggcaatttctgttgccaggcgaatcgggcgacctttcacccttccgctcattaattgcagggtactttccagcagcgggcgcggttcaaagggttcatcgctgaccgaaacattcttgccacctgcttcgatagccgaataatcgagaatatcgttgaggatggtcagcaacgattcaccagagtcggtaatcgcccgcaaatcatcgcgctgggcgttaagtgcggggttatctgccagcagttgcgcggtgccgagaataccgtacagcggtgtgcggatctcatggctcatcgccgccagaaacgccgattttgcctggctggctttttctgcttccgcccgtgcctgtcggtgttctatcaccagttcctgcaattcagctgtacgcgctttgacctgcgccgccagctgttcgcggtggcgattcagtgcatgaacactgctgcgaaacgcatccatcagccgcccgatggtatccagttcccgtacgccagcggtttccgggaaaggggagtcgatatcaccatccagcaagcgttgcagcgcctgcgtttgttctgcaagagggcgcgtgactgagcgataaaccacgcgccagaggatcagaatcagtgcgcaaagagaaactaatcccagcaataacaggctgtattgcccgcgtgcactggctttttccagatgtgccagcccgtgctgattacgcagctcaatggtgtcgaccagctgactgacttcgctactaaactgcgcgaattgggcgatgttattttgggcgagagtttgcaggtgattgctgatttcactgtcctgctgatacagcgccagcaaatcgctatattggctaacggtagttaacgttgttgctacctgagtacgaacacccggatcttcaatgcgtatttgccgacgttgcagaattttcaccgcattattgagctgcttttccagcgttggcgcatttttctggatctgttccagccccagattcatcaccatttgctgcacccgcagggcgctaaggcgcagttcattcatctggttaacatactcaagatcgatatcaatcagccgatcgagtgcactttctgcggcttgacgctgatgttgttcgatcaaatcgtaaatcccggcctgggtcgctccggcggaggttgccgcattattcgcctgaccttgcgccaggcgtgcgatttcatcggcggcggcgactatctgctgactgagttgctgttgttgctggcgaagttgcaaacgctgccccaccagttccccttgctgacgtaacgaacgggagatctcctgctcctgttgttcaatagcggtggtgtcaaaaccttgttcccgtaacgcttgcagcaacgcattaatcttcaggctttgtgcggtgagcattcgcccctgcgcctgccacatcttttcgttatcggcactggtcaggttctgcgcggcgaaaagttcccaggcgctggcttcgctcaactggcgcgccatattcatggtaggaatcaatgcctgagtgttgtctttttccacctggctgataaagcgcaggttgtaccatcccaccagggtactggtcagggttaacagcgccatcagggcaaagcccatccagagtcttcgggtcagggttaaattcacggtcggtgcactttaggtgaaaaaggttgagtcgcaaagcggaatgcatctagcataaagccttattattgatgaggctatcatgcgcgtactgctatttttacttctttcccttttcatgttatcggcattttcggctgatcacctgttgcgctggcatgatgcacagcattacacggtgcaagcctctacgccgcttaaagccaaacgcgcatggaaactgtgcgcgctttatcccagcctgaaagattcatactggttatcgttgaactatggtatgcaggaggctgctcgccgctacggtgtggatttaaaagtgctggaggcaggcggctacagccagttggctacgcagcaagcacaaatcgaccagtgtaaacagtggggcgcagaggccattttgctcggtagtagcacgacgtcatttcccgatctgcaaaagcaggtagcaaatctgccggtgatcgaactggtgaatgctattgatgctccccaggtgaaaagccgcgttggtgtgccctggtttcagatgggctatcaaccagggcgatatctggtgcaatgggcgcacggtaaaccactgaacgtgctgttgatgcccggccccgataacgccgggggcagtaaggagatggtagagggttttcgcgcagccattgtcggaagcccggtacgtattgttgatattgcgctcggtgataacgatattgaaatccagcgtaacctgttgcaggagatgctggaacgccatccagaaatcgacgtcgttgccggaacggccattgcggcagaggcggcaatgggggaagggcgcaacctgaaaacgccgcttaccgtggtgtcgttttatctttcacatcaggtgtatcgcgggttgaagcggggaagagtgattatggcagccagcgatcaaatggtctggcagggggaactggcggttgagcaggctatcaggcaattacaggggcaatcggtgtctgataatgtcagcccaccgattttagtcatgacgccgaaaaatgccgaccgcgaacatatccgccgctcgctgtcaccagggggatttcgtccggtttatttttatcagcacacatcagcggctaagaaataaccttcgccatgttgtgtcaccagtaaatccgcactgagtttatggcgtaaacgacgaattaacacatcgacggtgcgcaggtcagggttttccacccgacgcgcagagagcatacgcagcagacgttcacggctgagaatttcgcccggattagtcacaaatgccaccagcatttcatactctgcgcgggtcagtttaatcggctcgccatcccgctccagcgtatggcgcgacacattcaggcaataaccggcaaagcgatagcagttgtcctgagtgtgcggttgcgcctgtcgcgcgaggtcgattcgccagagcaagtttttcactcgtaccaccagttcgcgcagttccagcggtttggtgacgtaatcgtctgcgcccatttccagcccaacaatacggtcaatccgatcgctgcgtccggtcaccagaataatccccaccgttgagcgttctcgcagggcgcgggttaacatcaggccattttcatcgggcaaattgatatccagcagaatcaaatccaccggctgattctgcataatttcccgcagcccggcaccgctcgccgtaacggaaacggtatacccctcctgagtgaagtaagactgtaatcgcgcctgggtaaccggctcatcttcaacaataacaatgtgatgtggcatcagagggttttactcattctgttcatatctgttcatattctgccgtaagctattcatcctgaccagtgccgctgttcatatttgctcattaagatcgcttcactaaaccataattttacaggggctattatgcggaaactctggaacgcgctacgccgacccagtgctcgttggtcggtactggcgctggtcgctactgggattgtgattggcattgcgctgattgtattgccacacgttgggatcaaagtcaccagcacaaccgaattttgtgtcagttgccacagtatgcaaccggtgtatgaagaatataaacagtcggtgcatttccagaacgcctccggcgtgcgagctgaatgccatgactgtcatatcccgccggatattccaggcatggtgaagcgcaaactggaagcgagcaacgacatttaccagacctttattgcccactccattgatacacctgagaaatttgaagccaaacgcgcggaacttgccgagcgtgaatgggcgcgaatgaaagaaaacaactcggcaacctgccgctcctgccataactacgatgcgatggatcatgcgaagcagcatcctgaagcggcgcgtcagatgaaggtggcagcgaaagataatcaatcctgcatcgactgtcataaaggtattgcccaccagttaccggatatgagtagtggcttccgtaagcagttcgatgagctgcgcgccagtgctaatgatagtggtgacacgctgtactccattgatattaagccgatttatgcggcgaaaggcgataaagaagcgtctggttctctgctgcctgcttcggaagtgaaagtccttaaacgtgacggcgactggctgcaaattgaaatcactggctggacggaaagtgcaggacgtcagcgtgtactcacccaattcccaggtaaacgcatctttgttgcctcgattcgtggtgatgtgcagcagcaggtgaaaacactggagaaaaccaccgttgccgacaccaataccgagtggagcaagttgcaggccactgcgtggatgaagaaaggcgacatggtgaacgatatcaaaccgatctgggcttatgcggattcgctgtacaacggcacctgtaaccagtgccacggcgcaccggaaatatcccactttgacgctaacggttggatcggcacgctcaacggcatgattggctttaccagcctcgataaacgtgaagaacgcaccttgttgaaatatctgcaaatgaatgcgtctgacaccgcaggtaaagctcacggcgataagaaggaagaaaaataatgaacaataacgatctctttcaggcatcacgtcggcgttttctggcacaactcggcggcttaaccgtcgccgggatgctggggccgtcattgttaacgccgcgccgtgcgactgcggcgcaagcggcgactgaggctgtcatctcgaaagagggcattcttaccgggtcgcactggggggctatccgcgcgacggtgaaggatggtcgctttgtggcagcaaaaccgttcgaactggataaatatccgtcgaaaatgatcgccggattgccggatcatgtacacaacgcggcgcgtattcgttacccgatggtacgcgtggactggctgcgtaagcgccatctgagcgacacctcccagcgcggtgataaccgttttgtgcgcgtgagctgggatgaagccctcgacatgttctatgaagaactggaacgcgtacagaaaactcacgggccgagtgccttgctgaccgccagtggttggcaatcgacggggatgttccataacgcttcggggatgctggcgaaagctattgccttgcatggtaatagcgttggtacgggcggagattactctaccggtgctgcgcaggtgatcttgccgcgcgtggttggctcaatggaagtgtatgaacagcaaacctcctggccgctggtattgcagaacagcaaaaccattgtgctgtggggctccgatttgctgaaaaaccagcaagcgaactggtggtgcccggatcacgatgtttatgaatattacgagcagttgaaagcgaaagtcgccgccggtgaaattgaggtcatcagcatcgatccggttgttacatccacccatgagtatctggggcgcgagcatgtgaagcacattgcggttaacccgcaaactgacgtgccgctgcaactggcgctggcgcatacgctgtacagtgaaaacctgtacgacaaaaacttcctcgctaactactgtgtaggttttgagcagttcctgccgtatctgctgggtgagaaagacggtcagccgaaagatgccgcatgggcagaaaaactgaccggcattgatgccgaaaccattcgtgggctggcacggcagatggcggcgaacagaacgcagattattgctggctggtgcgtacagcgtatgcagcacggtgaacagtgggcgtggatgattgtcgttctggcggcgatgctggggcaaattggcctgccaggtggtggttttggttttggctggcactataacggcgcaggcacgccggggcgtaaaggcgttattttgagtggtttctccggctctacgtcgattccgcctgttcacgacaacagtgactacaaaggctacagcagcaccattccgattgcccgttttatcgatgcgatcctcgaaccggggaaagtgatcaactggaacggtaaatcggtaaaactgccgccgctgaaaatgtgtatttttgccggaactaacccgttccatcgccatcagcagatcaaccgcattattgaaggctggcgcaagctggaaacggttatcgccatagataaccagtggacctcaacctgccgctttgccgatatcgtgctgcctgcgaccacgcagtttgagcgtaacgatctcgaccagtacggcaaccactccaatcgtggcatcatcgccatgaaacaggtcgtgccgccgcagttcgaggcgcgcaacgactttgatattttccgcgagctgtgccgccgctttaatcgcgaagaagcctttaccgaagggctggacgagatgggctggctgaaacgcatctggcaggaaggtgtacaacaaggcaaaggacgcggcgttcatctgccagcgtttgatgacttctggaataacaaagagtacgtcgagtttgaccatccgcagatgtttgttcgccaccaggcattccgcgaagatccggatctcgaaccgctgggcacgccgagtggcctgattgagatctactcgaaaaccatcgccgacatgaactacgacgattgtcaggggcatccgatgtggtttgagaaaatcgaacgctcccacggtgggcctggctcgcagaagtatccgttgcatctgcaatctgtgcatccggatttccgacttcactcgcagttatgtgagtcggaaactctgcgtcagcaatataccgtagcgggtaaagagccagtatttattagcccgcaggatgccagcgcgcgcggtattcgtcacggtgatgtggtacgcgtctttaacgttcgtggtcaggtgttggctggagcagtggtttctgaccgttatgcacccggcgtggcgcgaattcacgaaggggcatggtacgatccggacaaaggcggcgagccaggggcgctgtgcaaatacggtaaccccaacgtgttgaccatcgacatcggtacttcgcagctggcgcaggcgaccagtgcgcacactacgctggtggaaattgagaagtacaacggaacagtggagcaggtgacggcgtttaacggccccgtggagatggtggcgcagtgcgaatatgttcccgcgtcgcaggtgaaatcatgaccacgctgacagcacaacagattgcctgtgtttacgcctggctggcgcagttgttctcccgtgaactggacgatgaacaactgacgcaaatcgccagtgcgcagatggctgaatggttttcgttgctgaaaagcgaacctccgctcactgcggcggtgaatgggctggaaaacagtattgccactctgacagtacgtgacgatgcccgtctggaactggccgctgacttttgcggcctgtttctgatgaccgacaaacaagcggcgctgccgtatgcatcggcctacaaacaggacgagcaagagattaaacgcttgttagttgaggcggggatggaaaccagcggcaatttcaacgaaccggcagatcatctggcgatctatctcgagttgttgagtcatctgcatttttcgctgggagaggggaccgttcctgcgcgaagaatcgacggtttgcggcaaaaaacactgacggcgctgcggcaatggttaccggaatttgttgcgcgttgccatcagtatgaccgctttggtttttacgcagcactaagccagttgttgcaggtgttggtggagtgcgacaaccaaaagggataatgccgatttgtaggcctgataagacgcgttaagcgtcgcatcaggcattatggcgcagttgccggatgcggcgagaacgccttatccggcctacgggaacagtgctttttgtgggcctgataagatgcgttaagcgtcgtatcaggcattagtgcgcagttgccggatgcggcgagaacgccttatccggcctacgggaacagtgctttttgtgggcctgataagatgcgttaagcgtcgcatcaggcattatggcgcagttgccggatgcggcatgaacgccttatccggcctacgggaacagtgctctttgtaggcctgataagacgcgttaagcgtcgcatcaggcaacaaactcacgggtgagccacaaaccgggaaagccgctggcgcagcaggcggttttcctgcttcaggtgcgcaatatcatccattaacgtcagcgccaccgcgatccccggccagtccagagccagttcatgacgcaggcgtaccgcgcgttgcaccacaatggcggcatggtcgtcaaatacccaggttgtctcctggatctcactcggttcaaccacccccaaaccgacaatttcattcaactcctcttcagagatgccggtatgcaggcaaaattcggtaatagtaaaagtcaccgtaacattagccattatgctttcccccaatctttacgtggatcaaaagacgactgggcgtctgccagttgctgccacagcgcggcagtgttttcatccggtttcggcggcatcacgattttcagtaccgcatacagatcgccggtctgttttttgctcaccagacctttgcctttaacgcgcaatcgttgcccggcctggctgccaggcgggatagtcagcaaaatgctttctttcagtgttggaacggtgactttagtacccagcgccgcttcccacgggctaaccggcaccactatttccagatcctggccgacaatatcaaacagcggatgtggcgcaatgtgaatcaccagccacaggtcgccatttggaccgccgttttcgcccggcgtcccctggcctttcaggcggatgcgttgaccattgccgacgcccgccgggatcttcacattcagcgttttcgggatttcctgttcgatcatgccaaaggcgttataaaccggcaggttatagctgatggtacgcttatgctcagtaagcgtttcttcgaggaaaaccgccacttcgatttcaatatcgtggccgcgtgtggcggggcgttgacggctctggcgggcatgctgaccgaaaattgacgagaagatatcgtcaaaatcttcggcgttaaaactctgaccgtcgccatgatggaactgacggttaaattgcggatcgttgcgatgttgccacatctgatcatactcagcgcgacgttgttcatcacttaacacttcccaggcttcggcgacctctttgaagcgggcttcggcatccggttctttgctgacatcaggatggtatttgcgggccagtcgacgataggcggtcttgattgtcttgagatcgtccgtcggtttcacgcccatgatggcgtaataatcctttaattccatagcgttatctcgcgtaaatcaacacaaattgaaggaacccctgtaaggtaactcctataagtgtagggtaatcctcaaaatttcatatgccaacacagaatatgttattgaaatcatcgcggaggggaggtcgcctcaaggtgggaggaacatattttatttacctccctcctgaacttttggctcatgcttacaagttaaacaataaggaaaggaatgcacaactcgactatttaaatcgttatgcaatttaatgataaagacatgtgctaaaaaccattgctattagtctcacattctttttttattggtaatggtaacgccgctgattttctatatagctactgatgtaatcattagcggcgtaaacgaggccggggctaatcaggcatagtttgcgtcaaaacttgcctgtttttaaaggggaatatagaaaaacaggcgttcaacgagccattttgcgaacctgttcccggaaaaatgacatatttctgtcacactctttaattattgataacaaaagaggtgtgaggaatgaacaaaacgctaatcgccgcaactgtggcagggatagttttactcgcttcaaatgctcaggcacaaaccgtaccggaaggctatcagctacagcaagtccttatgatgagccgtcataacttacgtgcgccgctggcgaacaatggcagtgtgctggagcagtcgacgccgaataaatggcctgaatgggacgtccccggtgggcagctcaccactaaagggggcgtgctcgaagtgtatatgggccattatatgcgtgaatggctggcagaacaggggatggtgaaatcaggggaatgcccgccaccggacaccgtttatgcctatgccaatagtctgcaacgcaccgtcgcgaccgcgcagttctttattactggcgcattccctgggtgtgatattcggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggactgttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattacctgatattcctgttcatcaccaggaaaaaatgggcactatggaccccacctttaacccagtgatcaccgatgattccgccgcattcagtgaacaggcggtggcggcaatggagaaagagctcagcaaactccagcttaccgacagctacaagctactggaacaaatcgttaactataaagattctcctgcgtgtaaagagaagcaacaatgttcgcttgtagatggcaaaaatacctttagcgcgaagtatcaacaagaaccgggcgtttccgggccgctgaaagtcggcaactcgctggtagatgcgtttactttgcaatactacgaaggttttccgatggatcaggtggcctggggagaaatcaaatctgaccagcagtggaaggtgttgtcgaagctgaaaaacggttaccaggacagcctgtttacctcaccggaagtggcgcgcaatgttgcgaaaccgctggtcagttatatcgacaaagccctggtcaccgatcgcaccagtgcaccgaaaatcacggtattagttgggcacgactccaacattgcctctctgttaacggcgctggatttcaaaccgtatcagttgcatgaccagaacgaacgcacgccgattggcggcaaaatcgttttccagcgttggcatgacagcaaagccaatcgcgacctgatgaaaattgaatatgtgtaccagagtgcggaacagttacgtaatgccgatgcgttaaccctgcaggcacctgcgcagcgcgtgacgctggaattaagcggttgcccgatagatgccaacggtttttgcccaatggataagtttgatagcgtattgaatgaagcggtgaaataacagaaaactcccccgcgtgaagcgggggagtcgctggttaaacgtttttacgttcgatggtctgttcgccccaaaaaagcgaatctttatcggtcttagcaaaggctttgactaacacttcatcgctaccttcttcccaaatcttttccgccattttttcgtcgtacccggcgacttcgaaaatggcctcggctatttccggcgacgtattgcgcagagatgcccattcaccgacgtgatgagctttcgcttcttgagttggcatgcgtatcctcctgttgaagattagccgttaagtttaactgccagacctgcgacatattccccttgataacgagcaatagacagttcttcctggctgggctggcgtgaaccgtcaccgcctgcgatggtggttgcgccgtacggcgtaccgccgcgaacctgtgaaacgtcaaataattcctgcgctgcgtagccaatggggacaatcaccatgccgtgatgcgcaagggtcgtccaggtggatgtgatggtttgttcctgaccgccgccagtaccggtggaactaaagacgctcgccagttttccgtatagtgcgccggaagcccacaggccgcccgtctggtcgaggaaggtacgcatttgaccggacatgttaccaaagcgggtaggtgtaccaaaaataatggcgtcgtaatcggccagttcttgcggggttgcaaccggtgcagtttgcgttttaccgcctgctttttcaaataattgcggcggcatggtttccggtacacgcttaacgacaacttctgcgccatccactttgcttgcaccctcagcaactgcgcgtgccatcgtttcaacatgtctaaggatatgctttatcattttgaaaaatataattttatttcatcctcctggtcactttggggcacgtctggggcacgggcattaaggacattattcagcatagcaacctgagtcacgctgcactcaggcatccatgcaccataaacattgtagaccatgctggcgctggagtgccccatctgtgatgcaataaatgtcgggtttgctccggcagataaagcccagcacgcataagtatggcgtgactgatatgctttccgggctcttatacccgctcttttcattgctgagtcccatgttgccccgatggagcttaccgcatagttaatacccgccttgtgattcttgcgaacgatttgcggacagaaaacaaaagtgcactcgtgcaaaattgttcttccgtactcgcgtaatttaacggtgatctgatgctgcctgccaagacgagtaagcatcgcctggtttttaagtgcttcaatggctggtgccagaagatgtataacccggtcggtgccagcatcagtctttggtagcgtaaaatcacctatttttgtaaaatttcttcgcactgttatcgtgccaactttcaggtcgatatcctcccatgcaagtgcggcaatttcaccatgtcgcatccccgtaaaaacagccactgtccagaggtttttggtctgttgatgatgacaggcatcaatgaggcgaccaaactcctctctggtcagtggatccggcacaggttttgatttcctcagtggtgttattgaattaaacgggtttttctccagatacccgttttcagcggcaaagctgaacatcccggcagttgttgtcatgtaatagtttaccgtggggactgttcttcctttgttggtggaagtgtttttcctgctttccttttccccagtcagtaaatctttcctgatgaacagcaaatcctcttttgtaatcgaggatgccagtctacccacgccaagcctcggtagcatatttttcatcactgattgataacgatttaaggcgttactactgatttccattgctttcagagtaagccatttctgtgccagttcaccgacggtgatatctttttttaccaggccaaatagcttcaggttaggtgagtcagggaatcgctcggcataatcaaacgttcctgttctgattgcaaagcagaccgaagcccttaactcaccagcgatctttctgtttttcggtgtatcgggcacgcgaagattttcgcgcactcgtttacccctgtacttaaacgttattcggagttttcctccgtgattttcaacgccggctggataggctgaattcgccattgttcctcctgcgtccaagagcacgctcaggttatactcttatggacaagaattaaacatcctgagatggtaagggttggtttttaatccaggtgttgatggtaggaagatgatagagacattcgctgtttttctttggcgttccgtcgggggcgatttgtttatattctctgccgttcatccacgcagcgtccctggcgcgtaatatggttccttttctcaggcctgttacagccattaaaagctccagtgttacccattcattcgcatttatctgtacaacaggtgtgatgactggttgaatgccatggctatgttggtttacgaactcgcgcataagttacctccgcatatgtaagaaaaaaccgcccgaaggcggttgtcagttgattgatgtgcggcgcatttttcgaaggctggcaatatgcttttccttctcaatttccgctttaatcatatgtagttcgttgtgatcgattcgctcaaattctgcattaaatgagttaattgatgcggctctggttctcccatccagccttcggaagatcacctgtgtcagcgttaccttgcagacttgaaccggatagttgttggcgtcgacgaaggactgcccgcgctggatcagaacgaacacaggtagcattccttaattgtcatatcatttgcacctcgttgctacggctatcgccattgctccccaaatacaaaaccaatttcagccagtgcctcgtccattttttcgatgaactccggtaccatttcgtcaaaaacctccatgtatttttcatcccgttcgaccacgacataatgcaggccttcacgcttcatacgcgggtcatagttggcaaagtaccaggcatcttttcgcgtcacccacatgctgtactgcacctgggccatgtaagccgactttatggcctcgaaaccaccgagccggaatttcatgaaatcccgggaggtaaacgggcatttcagttcaaggccgttgccgtcactgcataaaccatcgggagagcaggcggtgcgcatactttcgtcgcgatagatgatcggggattcagtaacattcacgccggaagtgaactcaaagagggctctggcgtcgttctcgtactgttttccccaggccagcgctttagcgttaacttccggagccacaccggtgcaaacctcagccagcagggtgtggaagtaggacattttcatgtcaggccatttctttcctgagcggggttttgctatcacgttgtgaacttctgaagcggtgatgacgctgagccgtaatttgtgccacgcatcatccccctgttcgacagctctcacgtcgatccctgtacgttgcaggataatgtccggtgtcatgctgctaccttctgctctgtgactttctgtttcaggaatccaagaaccttcacagcttcagcctgtgttagttctgaagatgtgtaaatgttgcggcgaaaaatctgggaacagagcggcaacaggtcgtcatcccacgttttttccatggaagtaagaagggcgttaatttccgacatggtttcttcgttaaccggggtgatgtcgcgttccggctgacgttctgtagtatatgcagtattttcgacaatacgctcggcttcatccttgtcatagatgccagcaaatccgaaggccaggcgagcacactgaatcatggctttgtgccgtaacatccgtttgggatgcgactgccacggtccggtgatttctctgccttcgcgggttttgaatggtgcgcggcgacattcatccatccactcggtaacgcagatcgggtgattgcgatctttgcggtaaatccggcatgtacaggactcattgtcctgctcaaagtccatgccatcaaactgctggttttcattgataatgcgggaccagccatcaacgccaaccaccggaacgatgccgttctgcttgtcagggaaggcgtaaatttctttcgtccagggattaaggccgtactggttggcgacgatcaacaatgcgataaattgcgcatcgctggcatcacctttaaatgccgtctggcgaagagtggtgattagttcctgtgggtcgacagaatccatgccgacacgttcagccagcttccctgccagcgttgcgagtgctgtactcatccgttttatacctctgaatcaatattaatttggtgacgggcgatggtttcagccatgtagcggatgtgttctgccatgcgttcctgaaaatcgacatcgtcatcaaatgcacgggaaatagcttttttgctggccccgtgacgttgcagattatcgatgcatagcgattcaaacaggtgttggggcagacctttttccaggtcgtctgccagctcagcttcagtttcttcacgggcaatttgctggtagtgtcgtgcccatgactgctcttcaatgcgatcggggataagccaggcattcatgatttatcacctccgaaattttcaagcctgttggcaatcatgatggcgatatcagggattgctggcgctgtggctatacatgcggggttggcgcacaaaccatagacggcggcaatcacgagctgtcttttccagtcgagagttactggctcagaattggcgtcatcgccggacgtatcactgcctggctcgttctgaacaacggtttcgccctcctgagcggcatcaacagagttttcctgaatgatcttctcctcagtttgtgcagagtcttctccatcagcggcgtcattttctccaaaagtttctgtgtaagtgctatcgcccattaccgcactacagtcagggcagttacccccgccagtctgaccacagacgcggcagtttttttccagctccggttgcgctactggccctggctgttgctcttctggcccgttttgttgcgtatccgggctgttttgtcccgcttctggggcaatttgttccactttggactgattctggtcctcagtgtcgcgagtctggatccccttcacccacttcggatcagcagggttactgatgccttcaacgaattctccacgcgaggcagccagtaatttgtcggcatcgactggattttttggggggatgttttccctggctttattgagttcctccctcagttcctggtatttcgtttctacagatgagacattttccagtgattgcgtgtccgcattatgtttaactggaatttcttccactgattcaggcgctgcctgttcattagacattgcgtccgatgtttgctgcttttcttcatcgtcatgtatctcttctgctgttccgcgctgcggcattggggctgatgagcgaccgcaggcgatttccacgatttccggatccgggttagagtgatcggtttcggtcaacactttgttgagatattcagtcacgcgcgccgggatagcctcaatgccgattggtgcttctttcactgaagccaccacaatggcgcgggaataatccagcccaccgggcatggcgatgaatttgtcacggaaaacagaaaagggcggcttattctctgacacgatttcttcaacgcgttttgcgtgtgctgggtgcaggttataaatatccacatccattgaacgggccagaacgccagtggcaatgtctcgcgccagtgatgcctgattgtgggtaaagccttcgccacgatcggtaagatttccgccgccagcgttagcaccggaaggcgtacgagtgatgcctgtaacataatttcctttctgccattcttttgccagcaatccctgatccacatagtctgttttcatccaggtggagatgaacttgtcgaattcagccgggctgatgcgatgatttgcagagtgggggaatgctttccctacagattcagccaggcgactaaggtgatagttcgtcagtttatccagttcatgatgcgcggcgcgcacagcagtaagcaggctctgaaggtaactgtcctctgtgtccatctccatacggatcacgttattgcgttgttctggtgtggcatgatgccggtattttccatcttcatctttgctgaataagaagaggtgaaggaagcgatgagtaaggctcagagtggcgacgggaatttcacactcagaacagtcatcgtcgctgtccggggattcgcttttctccacatcatccggaatagttccgtccaggttatcgttgtcatcgccagcagttgtggcatcttcaccgttgatgttgtcatcgaaggggatagccatcatggtgatgccatcgttaccgcctttttcatagcggttgcagaattcagtatcaaacacgccttccggtggaaggtcattcacgacggggaaatttacgcgaacgggttttttgaaatcatcctcgtcgtagcctgcatcgtccatggctgcaatgcagcgggaaactgcgacagaaagttttctggcctcggtccagaaaaaaccgcctttgatgccaaggcgttttctgactttatcgttttttgcttcgcagtgtagtgcaaaagtctgtttatcagcgctcattgtatttaaacctctggctggattagaattagcggccctttgtctgatttctccgaatacggtgacgcagggagaaatccggtagcctgcgctgccggatttttatttcagtggaaggttgcctggtttgctgttttgtgagttgtttttcccttttcgtgctggcattcagggcagtcgcactcagaattttctcttgcaaactcaagagcctgtgcaagtgtatggatttgttgtgctccaatgttgcttctgacgacttcacatgcagcatgaatatatgggcttggtgttttgccatttaacccacataaaacaaaacgactgtccttatattcgttatttccaacttctgtaagcactgaaaaagaaaatacaaagtcgattttgtattctttgcatattttactgatgcgttctgcaatttcttcgagttcatttattgcatcaggactggtttcggaaaatatttcattttgcgcaagttctttcattttgatttttccgtgattgataattaatgcggttttatttcggcttgtctgttacagatatggaaggtgtattttattactcgtcacaacgacgctgcttttacgggtaagccatcgcgcccgatgaaaactttaatcatgcagtcggtaatgcatgtttttgttgtgaagttacgaatatagagttttctcttttcaatattgtttgctgaagcgatatatgtccgaccttcatgaagaacataatcgccaggcgtcacgcactgacgtggtatttcatcagttccgaagtgatgagcaatcataattatctccattttcacaaatgaactttgttgatgcggtgcctggtgcctccaggtgacgttaaccagttaacaactaacgccgggtcaggggacgatgactttccgtgacatcctgtcggtttaactgttccgcgtgcgcatagccgcattcaccgcatcacaaaattcactttaaaaagggcggacatcagcaatcggcaaaccgatgtccgccaagggctacacacagcaatgttgttattcacaaccggaagcgcacggtcgaagaaatctaacgacaagccttcaatgggaaagagtcttcgccgtgcactttcgtgttgtaccctggctttcagggtaatgtctgttcagtaaactgagagtgccggaacttacccgtgtccggcgcacgatctccacctcacccgtggagaactcctcaactacaaaccccgtaaggagagtgaatttatgacacaagaagaaaaagtgatgtttctgatgcggctggctgtcgatacctacaacacacaattcagggagaaagatatacctcaaaaggcagttcctgctgcggtagataagggcggtgctattgccgtattttacgatgcatttgaatcattttttaatgaaaaactcgacgctgttagcggcttcggaacatcgagtaataaataacgttcattacggttcttaaacaacaatcagtgggcttgatgttgttcttttcaagctcacttgccatcacttccattattcttgcacttacacgaattatttggtggctgtaagcgatgcaactgtcgctgatattgctgtttatttctattacttcattttcaccattagcatcaacttcggatgcgctgttttcattatcctgtttcagtgctttttctgccatctggatgcgtgtcagcgttgcggaatttgggctaagtcgataaacctgtctggcatcttccagaagcagggcgataatgtgcttcagttctgtttcgttcatagttaactccggtagttgcaatttattaatatcaggcggtcagctctttaagcttctgaactgctttattcatttcatccatacagtcgatgaattcgtccagtttaagctgcatttttccggcggcctgaagaatttcaagttttaagggcgcaagttttttgttgaatgcatcatcttcctggcgttttttctccgcaatttcggcggctttcagcaattcttcagcctgttttctgagtatttctggtgaaggtgaaactgctttgaggttattcatttcaggttcctgttgttgcagaattaatttgttgcattctctgcgtgagcgtttcattgcagattcgcacttcttgcaataaatggctctcccgtcacgcttgctggcatctgaataaaaatcattgactgattttgtctgcccgcatctggtacataattttgattgaaggtccttaatgattgtgacgtttccttcccgtttgggatatccatattttttgtggcggaaaaaggttactccgttaccagaaccttcttttctgaccttaaatacaatgatgctttcccgtttatcgataaaatctatgagctggtttctctcctttcctgacagttcggcaaatgtcttaacttttttagtaacttccgtaaggcgaactccatcaggcattttttcaacgaagtttttaatctctgcaagcggacgccataacttttgcggcaaaactgaaggcgtggtcatcaatcacctcgccgtcagttgttttgatttccggtagcctgccgcgtaaatggctacgtttggaagacatacaccagtttctggttgcttatgtccaaactcattcgcgtacacaatggctgctcgctccagattgcgtctgtattctttctgttgccagatcacgtcctgtgccatgaacttaattggcttagcgtcttctatgcgctcaggcgtttcgtgagtacctttagcctgaatctgcgctctgcttagagtagggcggtgtaatacttctgaacttattgcttcttcgcgggccagcacgccgttagctaatgcctttgcctttaaacgctcacgacgatgagagcgtgaattgcctttgaactgagttctgcgtgtcatatagacctcctgatgaactttggtggtgtggtaggtgggagacccatttcgacctgtttcggcctacttcaattcggcaatagtcccgcaggccccgccgctttacgtgcgacatattcccgtccatgaacccttcaccacaccccaaagttcactttggttattgcgctttgtcagcgccgtagattcatatttgaatcgttgtatattcaccgccctggtgagtagtgcgtcctgctgatgtgtttagtatcaccgccagtggtatttatgtcaacaccgccagagataatttatcaccgcagatggttatctgtatgttttttatatggatttattttttgcagggttgagtggcttgggaggtgatcgagagatctgaattgcgatgtttagtgagttgtatctatttatttttcaataaatacatttggttatgtgtctttaggtggggggggggtgaggcaaagaaaacccggcgctgaggccgggtttttctaggctaccagagactcaatccaagagtctctggtatggaatggcaacactcgtgcggtatcattaaatagtagtgatagttgctgtagctcaggtgttaacccatcgctgtcaactattacaaatctattgtttatgtcaggaacgacctgacttaagtcaacaatcttcccaactgttgagtgggcagtattccatcccttactgctggcaaggcttaccgtaaacccgcgttttggtggtattagtcgagactcattccttagcgttaacggaacagtaatgttatgcccactaatacctttcactttttcctttaaggctagtcgcttcccaagccctgctgattttaagtaactgattacacatttttcgaacttatcgtctttgacctcagcataccaatcagcagtttgggcggatgcaagaatcccaccacgaataacatttgcagttacctgtccaacggacgactcatctgcccacgcagatatctctccagagtcatttaatgaaattccttgcgaagcgagtgatgacctgatcagatcaattttctttttagtcaggtggatgccgcgtgattcaatattcatcaatgtatcgcagtagtctgtaaccctatactgaccactcatctcttgaacgaatacacttatctgctcacaatcatcgtagtatgtgaatggactaataacgcgcagcaacgtgtcgctcattgggtggcattcaaacccgagcttagatatgactgttgaacacgttacatttcccatgataactgacctgatttatcttgattaggtaaaggtgggctgccttcatatatgatattaagcgcctcgcaaaaataattccagtagccaaaaaaatcatctggcttgatgttcgtttcaagcttaagtgcaatttcttccccagctgattcgaagtacatgtgatagtgaggacctcgagccacctcaacaaaatctggatggttcactatagatttattacggtgtggcttgttatccgcagggtacggatcaagcgcgtaaatgcgcctgtcatgaagaaacatcacaaatgaaatcttcactatatccaccccttcaacgataggaggacgccagtgaagcataaatcttatgcctgtgattgggttgccaatttcatcaaaagctttgagatccaatttaaaccagattggggttcgtccctcacttccggtccatgtaactccgctaaaagttacttttttcaagcgagtaatagcttggtcaacctctttctgggtaggcttaaagtcgccttttttagccactgattcgtatcaccatgaaagttattgttaatacctgtgcttcttgtcacccaaacgtctcttcaggccactgactagcgataactttccccacaacggaacaactctcattgcatgggatcattggatattgcgggtttagtggctgtagaaacacctgaccgctatccctgatcagtttcttgaaggtaaactcatcaccaccaagtctggctatgcagaaatcacctggctcaacagcctgctcagggtcaaccagaattaacatcccgtcaggaaaactaggtttggatcctgttggcgcggtcatggaattaccttcaacctcaagccagaatgcagaatcactggcttttttggttgtgcttacccatctctccgcatcacctttggtaaaggttctaagctcaggcgagaacatcccggcctgaacatgagaaaaaacagggtactcatactcacttctaagtgacggctgcatactaaccgcttcatacatctcgtagatttctctggcgattgaagggctaaattcttcaacgctaacgttgagaatttttgcaagcaatgcggcgttataagcatttaatgcattgatgccattaaataaagcaccaacgcctgactgtcccatccccatcttgtctgcgacagattcttgggataagccaagctcatttttctttttttcataaatagctttaaggcgacgtgcgtcctcaagctgctcttgtgttaacggtttcttttttgcgctcatgcattaaatctatcaccgcaagggataaatatctaacaccgtgcgtgttgactattatacctctagcggtgataatgattgcctgtactaaggaggttgtatggaacaacgcataaccctgaaagattatgcaatacgctttgggcaaaccaagacggctaaagatctcggcgtatatcaaagcgcgattaacaaggccattcatgcaggccgaaagatttttttaactataaacgctgatggaagcgtttatgcggaagaaataaagcccttcccaagtaacaaaaaaacaactgcataagtaacaccgctattttcacaatggacattcgtcctacgtcgctgacaaagcgagccccaagatatctgaccaactaaggccatatgcgtttccacgcatacctttcaactagctattcactattggaaatcttaagaaatggaacaaacaagttacagcaaactgtcacagcgcgatatcgatcgcgctgaaacggatttacttatcaacctgtcagctctgacgcaaaggggactggcgaagatgattggctgtcatgaatcgaaggtcagtcgtaccgactggcgatacatcgcggcgattttatgcgcgtttcagatggcatctgatatcagtccgatcagccgggctttccagcatgccattaacgttcatgcaaataaaaaacgtccggttggggccggacgttctgagcaaatcctgatgaatatctgatattcaggcagggcatggagcaatacacgggaataattctgccacatctggaagaatttcgccagcaacaacaccaaccgcagcagcctgaagccgattgggttaacccggagataccgggaccgtctgtgaagatgtgcagtcacaccaatgtgcagtcacaccaaccgcagcagcctgaagccgattgggttaacccgggagataccgggaccgtctgcggtatggagtaaatcttgtatgcgaggggactatgcgtaattacgcaacaatttcacctcagttctggttaggcgaaacagggagaaaactaaggaagtctggtccggaatgtatggtagtggcgttgtatatgatgacctcgcctcattccaatatgctgggcctttattacctgcctgttttgtacattgctcacgaaaccggacttgatcctgaaggggcttctaaggggcttcaaatggcttgcgaggctggtttttgcagctatgaccatgattctgaggttgtatgggtgcatgaaatggcagcatggcaggttggtgaatcgctgaaacctggcgataaccgttgtgctggggtaagaaatgaatattccgtgttgctggaaaatccttttttatcatccttttatgatagatataaggatgatttccacctggatgtcagacgtgaatcatgtcggaaaattgaagccccttcagagcctctttcaagccaagaacaggaacaggaacaggaacaagaacaggaaagggataaaacccttctggtccatggcgaaaaaatcgccacggacccgcagggggatttttgtcctgttctgactgaacgtccaggaccagctggcacgacaccggaagcagattccgggcgttgtgtgcagcaggtgctgatcgtcgaaccggagcaacaacgccaaccgcagcagcctgaagccgattccgcgatgagcgggaagccgattgggttaacccgggcgatgccgggaccgtctgcgggacgagttgattatcctgacgtgttcgaacgggtctggcgtgaatatccgcatcgggcagggtcaaacccgaagaaatccgcgttcaatgcctggagggccagattacgcgaaggggtgtcaccggatgtcgtgctggatggcgtgaggcgttacgcaagatacctggaggctaccgggaaagcgggaactgaatttgttcagcaggcatcgacgttttttggcccgaacaggaatttcgaaaatccgtggtcgctgccgaaggctggcgcagtcagcctgcgttgcgtgaatcacatttctgaaccggacaccgaaattccgccgggtttcagggggtaatcagccatgaaaaacatttcgacaggagggattcttgaacgggtgcgccgtctggcaccaccgcacgtggcagcaccgttccggacgaccgacgaatggcgggaatggcaactggctgagggccgtaagcgcagcgaggaaattaaccgcctgaatcatcaggcgcgggttgaaaaaatcctgaaccgtgcgggcatccagccgcttcacaggaagtgctcattcgggaactaccgggtgcagaacgacggtcagcgccatgctctgagccaggcgaaatccattgccgatgaattgatgaccgggtgtacaaacttcgtgttcagcgggaatccgggaaccggaaaaaatcatctggcggcggctgtgggtaatcgtctgctgaaggccggtaaatccgtgatagtggtcaccgtggcggatgtgatgagcgcgttacatgccagctatgacgacggactgtcaggggaaaaatttttgcgtgaactgtgcgaagtggacctcctggttcttgacgaaattggcatccagcgtgagacgaaaaacgagcaggtggtactgcaccagattgttgaccgccggacggcatcactgcgcagtgtcgggatgctgacaaacctgaatcatgccgcaatgagcacgcttcttggtgagaggattatggaccggatgaccatgaacggtggtcgttgggtgaattttaactgggagagctggcggtcaaacgttggacgtcagggtatgtgagaatttttgacgaggtaaattttcgatggaaaccgtattgcatgcactgaaagcgatgggaaaagccaattctgttgaactggcggcgcggcttgatatcagccgtgaagaagttctcaacgaactgtgggaactcaaaaaaaatggcgttgttgataaaacgggtcacacctggtttctggctgtcgaaggtgaagccggggtaaccgaagggcaggcactacaacctgaagcgctggatgtggtaaccgaagaggttgctccaaaagttaccgcagacatgatgattgagtttatcggtcaggatggtgctaaaacgtgtgaggaactggcgggtaagttcggtgtcagtactcgcaaggttgcttccacgctggcggtggtaaccgcaacggggcggctggcacgcgttaatcagaacggtaaatttcgttactgcatgccgggcgataatttaccagcagagccgaaagccgcgccggtaacggaaaatgatggtaaggcctttcctcagccagcaggtgctgcgttaccagtccgggaagccgcaacacaggaagaaattaaaacagaaactgtggcggacattgtgcagtcgttgccatcgtttaccgaaacgcaagcagatgagctgatttttccgtccctgcgcagggcaaacctggcgctgcgcagggcgaaaagtgatgttcagaagtgggagcgagtctgcgccgcgctgcgggagctgaataaacaccgggatattttcagttcgattgctgatattccggttcattcaccgacaacaaagtgatctccggaggtgcttatgacaagagcatttacaccagaagagcgggaaaaaattaaggggctgatcgtggaattcgtacgccttaacggacgaggcacgattcggcagttatcggatgaaattggtgtcagtcatgcgtctgtcggtcgtttatgcatggagctggccgccagtggtgatgtttacaattccggttacggagtattcccgtctgaacaggctcgtaaggactggcaaaatgcccgcaaaaaactctcaagggcaaagtcgaagaaaccggttgtcgttgatccagaccttatccgggcattaccagatggggaaatacggcgctacgacagacgctacaacacaatttgtcgcgagtgccgtaacagcgaaacgatgcagcgtgtgctggcattctggcgagggagtgcagagggattgatgttctccccgtcgtgaatgacgggggcttacgtgttcagaaaagtgattcatatagaggctgaatctgatcttttttgttcacgtctggcttccaccattgcaggcagagtgaaggcgtagactaaaaacatttcggtaaaactcaggatctggcttgcctcaattggtgtgaaaacttcatctgtatgaactgctttattggcatcaattcgtacaatatgagcccattccttcatctgttcagtgatcaggccttttttgtaaatcatctgaatacgttgcgacagcgattcttttcctgcttcatcgccgagcagttttttcgtggagatatcgaggactctgcgacaaagaataaccactgtgtcgtaccgcctcctctgtaaatcctcttttgcctcaacaaaagtacggtctgcaaccgggggtgtatattctggtgcggtaatttttttgaccacaggatagatcttgcggaaacggtactggctatttcctgaaatcagaatatcgaggtcttttttctggctttccgccatgggaccgtgatagtggtctgatgggatttcaacaatagcaacacctcctcgatgacaacttctgcatacaaaagcgatgttaaaaaaaggtgttttttcaatttgtttttcggcaaatgcctcaataacagctcgctcttttaaacagtgcgggcatgtgatgtcaaaggagactaaacccatggatattcctcgcgaaattaaagaaattaacgaaatcattgaggttactgatcgccccgagtttaccctcatgcgtcgttatgaaacaggaaccgacgaacaaaaatacatcatggttacagcattggctgtgatggcgatagaaagggagcgaagggaaaaggacgtaatggttattcctgagagaaatgattcaccggatttgagatggcaggagccggagtgggatgtggtaatccggtgattgatatttctctggggtaaagcgccgccagaatgacggcgcggtagtggagagttaaacgaagcggatctggagttttttccctgtagcacgggcgaattttttcagtgtggcaaatgatgggccgcttgtacctgatgcaagattgctttccattctggttatcgcagtcgcttttgttcccatacgttcagcaacttcagcctgggttaagccagcttcttttcgtgctgccagcatttcatcaagtagtgcgaattcatcggcgatggcgtcgtattctgcttttactgcggggttagacaacattttttctaccatttcatcgtgtgtcatggtaggtggggtacgtttaccagtcatgcttaacctccttcattctggtttcagcttttctaagctcggcaggtggagttttttgcgttttctttacaaagctatgcaacataatgattcgctttccttttagcgtgcagtaaaaaacacgccctatgccttccgagcccttaaggcggatttcaaacaaaccgtcgccaaatgcctctgtatgcggggaaccaagattagctccgtaaatacgcattttctccgtgtaccgaatgtaccgggcttgtaaggtctcaggaagagaaaggatctcagcttcaacctcgtcactgtagtattcgataatgtagtttatgagagtaaacataacaaatttgttatatacattcaaggtatgttgacgacaacacatatccgggattatattcttcgcacgccagcaaaatctggcgtcgggattaggaaccccggatagaaaccgcgacagagacacgccgcgagcgtgttttttattgtcgtatgcacacgcacatctgaattatggtggggcgtataggggagctgaaaagctcgccggttggtttcccggtagttcctaaccctgtacgtctcgccacccgatgattaggaacctgacggtggtgatagtttagaaaccactcgagggcgtcattatgacaactcaagtttctgttgaaacactctccacgattacttacaagcagatccccgttatcactaccgaacttttggcgcacctttacggcacagaagctattcgtattcgccagaatcaccacgaaaacaaaggtcgtttcattgaggaaaaacacttcttcaaacttgaaggtgaaactttacgtgagttcaagcacagagtagcttttaactactctgtgaaaattgcccgtaacgttcgctccctcatcctatggacagaacgcggcgcagcccgtcatgcaaaaatgctcgaaaccgatcgggcgtgggaagtgttcgaaaaactggaagactgctatttcagccagggaaaaacaacacaaaccgaacagcagtcgcagattcagccgcaattcacagacgaggaaattatcctcctctgctacatgcaactctggatggaaaaagcccgggaccttagcaagcagctgtaccccataatgaaagagctgaactcctcatacacgaacaagctgtatgacattgcgtttgagaccatctacatggtgacgaagaacagagacgcgctactaagggaggtaacacgtctcgacatgtcaagttccgttatccagcgggccatgccaatgctggaaagcctgcgggcaagacaatttgaattctgaaactaaaggagcttcggctccttttttgttgggaaaatccagtgagagggaataatgaaccagactatcttcctccgaagtaagcagcagcaacaattcgccattaacgccatccttgcaacaactctcgataaagacaaacccgttacgatccgtatcaccgattacaagcgtaatctcgctcaaaatgcaaaatttcacgcgatggtcgctgatatatcccgccaggttaagtggtgcggcaggtggctaaaaccagaacagtggaaagttttgttaatcagcggtcatgccgtggcgacaaaacaggaagctgatgttttgccaggtcttgaaggtgaatacgtcaatatccgcgaaagcagtgcgcagatgagcgtgaagcgtatggcaagcctgattgagtacacaacttcctgggctgtggatcagggtgtcagatttaccgacaggaggtatgaatgagacgacagcgacgaagcatcaccgatatcgtctgtgaaaactgcaattaccttccaaccaaacgctcccgaaataaacccaggccagtccccaaagaatctgatgttaaaaccttcaactatacggctcacctgtgggatatccggtggctaaggcgtcgagcaagatttaattgtcactccggatagcctactgcatgaggaataagatgatgacaaacctacgcaaagaagcgcgcggcagagaatgccaggtacggatttatggcgtatgcaatggcaaccctgaaactacagttctggcgcattaccgaatggctggaatttgcggaacgggaacaaagccagatgatctgttggctgcatgggcctgtagtgactgccataatgaaatcgatcgccgtactcgcattctcgacaacaacgacgccagactttaccacctggaaggcgtgatcaggacgcaggcgatactgctgaaggaggggaaaattaagtcatgaatgaatatgagtttgtgcttccctggccgccgacggtgaatacctactggcgaagacggggaagccagtactacatcagcgataaaggccagaaataccgaaaagacgtacagcaaatcatccggcaactcagattagacattttcactaaatcacgacttcgcatcacaattattgctgaaccaccagattcccgccgtcgcgacctcgataacatcctgaaaggtttactcgactctcttatccacgccggatttgcggaagacgacgagcaattcgatgacattcgcgtaattcgcggcgtgaaagtgcctggcggtagagtggggataaaaatcaccgaactggagaacatatgaacgccacaattcaaacaataccggaattgcttatccaggcacgaggcaatatgactgaagtttcacgaaaactgaactgtaatcgtgctacggtcagaaaatatgtcggtgataaagaaggcaaacggcacgccgtcgtcaacggtgtccttatggttcatcgtggatgggataaggggaaagctactgatgcgtgatattcagcaggtgcctgaacgcatggctttattcaggtcgtctggaaaagcgcatgagcagcgtaatagcggagttcatggcgaagagtatatgaacagattattcgaatgctatatgagactgaagcacggagatcgctatgacctgacatgtgatgctgacggcttctactgccgtgaagttgtgaaacgaatgtttgaagtgtggtgtcattgtaaaggatgggggctgtgatgcggctaaccccagtattcggcatggttaactttattaatgatgctcatttccgccgcatatggaggcatccgaagaaaatcattaactctcgtcagaaagcatgggttcactacatgctacaggtatggggaaatgttaacgctggtgatgattctccttgtggtgcaattaacgttattgggcgactgatgattcgcagtcagtggagcgatgacaaagctaagcagattgagtctgttgtcatgcgtctgtatgaagaagacggactacgtggagatgaactccatcagaaagcccgagaactggtcatccctcagtcatcggcaggtaatatcattgctctcgccaaagaatccgatgatgctgctttcgttgaacgtgtgatggttgagacctttcatcgtgaaagccctgtccgtgatgtagctattaggcgatattgcaatcgcgacagcacgcaagatatcgccaggatgatttctcagataacaggagttgatattcagtattgccggaggcgggtcgtgtggtgcgagagggtccttgattcagaaatgttttatgcaatgaagcgagaattggagaaagaacttctagtgattgctggatgatgcaaaatattttttgtaaatgcgttgctttcgagaaatgaaagtagtatgttttgtgtatgctcggagcaaaagcgcactgagaagcgaaagagaaatcctgatttacctcggtcgtcgataatatttaggatcggcatactggctagattaggtaaaggcctcggcagaaatgtcggggctttttgtttgcacaacaggtaagagcattgaacccgcagacctcgtggaattggtgaaaggtgtgcgcagtgctcttatcgttgtggtgaagctcaatggcgagctagcagacaggcgactgtgaaaatactagtcatgtagcggatcgccgcgcgtattgtaatcggcagcgcaccgatgggagctggttcgattccggccgccacaatccaaactgagccgtagcctctgggtgtcctgaattcatcagtgatagttacgctgcggccttctacatacgatttttgtgaaaagcgggtggcaagaggctgcgaaatttttaaatacctcacaattccacagcttgatgattgtctggctgccggagaatttgttaaaaattacatcgcgtggtgaatccccctcagcggcggggcatctggcaaagtgtatgatccagcgaacatgcaaattcagtagccaggctgaatttaccgggaggcacctggcaccatgcgacagacagaaattaggctatacttcagcccctctccggaggggcttttctgtgcaggatgtgtcacagtttcctgaattctgagtactgtcctgttactcagggtgctatattttctgacgtgatgaaagtctgccggaaggcggaacgtatcggaaatgacccagtagagaaaacgttgactcagataccgatgctgagttaccgggaaaccggcatcacatgaccgctatccttccaggctcgctccggcgggcctttttactgcagaaaacagttttcccgtaaaatgccacgttactcacaattcaggctggcgattattgtctggccagcgggaagtttgttaaaaaaatatggcatggtgaatcccctgtgcggaggggcatatcagcgacaggtgtttggtcacaccccttatcctttctggtgcgggttcaggtgctgatactgaactcaccgggaggcacccggcaccatgcatgaacggtacatagcgctactctccagcccctctccggaggggctttcttgttggataaaaaaaagcccgcgccgggaagcgcgggtggcaaggaataaacaacaaaacgtgaagtgatcaattttcagctggcgaataatacccgacagtaatcactctgcgcaactgtatggtctttttcgtattgcgggctgtagtcatcctcctgtttctgaacccttgtccatgactgacgtcagcccgcatcttatcttgattgcatacactatccctgccgggaggaataatggcatttaaacactatgacgtggtcagggcatcatcgccgtcagacctcgcaggaaaactgacgcaaaaactgaaggaaggctggcaaccctatggtagtccgattatctcaaacgcgggttatggtgctgaatttatccaggctatagtcgctgaaggggatatgacctctccggtagtttcaccggggggagatggtacccggactgttgttgttgaaccagaatattactttgtcattgcgctggccggacagtcaaacggcatggcgtatggtgaaggcctgccgctgccggagacatatgaccgtccggacccgcgtattaaacagctggcgcgtcgcagtacggtgacaccgggtggtgcggcctgtgcatataacgacatcattccggcggaccactgcctgcatgatgtgcaggatttgagccgtttttctcatccgaaagccagcgcagagcagtatgggtgtgtcggacagggattgcatattgccaaaaagctgttgccctttatgccggaaaatgcgggtattttgttagtgccgtgctgtcgtggtggctctgcgtttacagccggtgctgacggaacgttcagtgaaagttcaggagcgtcggataaatctgaacgatggggcgttgataagccgttgtataaagacctgctgacacgcactcaggccgcgctgaaggcaaaccccaaaaacatactgctttgtgttgtctggatgcagggcgagtttgatttaaaacagggagcgtacgccagtcagcccgccatgtttgatgccatggtggaaaaataccgttctgacctggcgggagtatccggtcagtgcgctggtgcttctccttctctggtgccctggatttgtggtgacacgacgtactactggaaggagacgtattcagcgcaatacgatgccgtctatggcgcatacaaaaccaaagccggtaaaaatatcttctttgtgccgtttatgatggatgacaatggtcagaaagtcgggaccaatgaaccgtcagaagacccggatattccggctatcgggtattatggttccggtggacgaacggatgcgaagagctggacaacatccgatcgtaaaacccactttggttcatgggcgcgtcgcggaattatttccgaccgtctggcaacagccattcttctgcatgtgggcagagtggcagattttgtttccgggaaagtgacaaaagccgcggtttcttcaggcggaggcgtatcgcaaccagcacaggagagtggcgatactcagcctgaagccgttgtcccgacaaagatacagtcagtgctggcttatgatgtgaatgcggaaaatgccgctctggcttcgcagggctggacgctgacagatgtcaaaaacacgctggtcagtgacagtggttcaggtaaaaaagcccttcgtcttgaaaaaccagaaaatggtcttgcacagaaaaagacctggaaagtatcgcacgcaattgatgccggtaaggggaaggagctgttcgataacggcggtgaaatcacgctgcgctttaaaatccccgatgatgtatctctcaatgcttctgcaaatcaatattctgcgggtatttactggcgcggtagtggatggccgggagcggaatcagaggagggttatattgcggccttctatctgcagactgataaaacaaacatcaatgtgatgtatcatgcaaacaccacatcacagcggcttggtagttatggtccgttcgatcacgactggcacacgctgactttccgcttcccgggtggtggctcgctgaacgtcacgccggtgcttgataatgcagcaggaaaaccgtttacgctgaccagatggacgaatgcagcctttgaggccaacgcgctggcaattacggatattaccggaaatgcggcaacttaccctgtgctgattgaaagtcttactgttggtgtgaatgccgtagcagcataacagacgaaaaaaaaccgccagcaacaggaatggagactggcggaggtaatcccaatggagaatctaacgaaaggatgctttcgacatcaatcatttctaaatgaaaacagttctcattgtcaacagtaacggtaataaaccatgacattcatcaaccagttaatgctgtacttctgtacggtggtctgtgtgttgtatcttctttcaggtggatacagggcagtacgcgacttctggcgcagacagattgacaaaagggccgctgagaaaatcagcgccactcagtcagccggagcaaaaacagaagccccactcattccggaacaaccttcttaataacccctttcaacgagaaaatctcatgacagatataaaacaactggtcactgctgaggcagtgaaggaagtcattcgctctgaagaagtcagaagcgtcctgaaacaaaaactccgccagaatctggaagagcgtcttgatgcagaagtggattcaattctggatgaattgcttggtgcacagccggaaccatccccggaactgcttccggaaccacaggcggaagatgtcaccacggaaaatggtgatattcagccggagtcaccggtgacggatatgacagacacacaacccgaaccgggcacaatgctgtaacggcggggcagggccatcagtaaagagctggtggcttttttcattttggtgtcttccgtctgtcggaggtgaggacgtgtatcagatggaaaaaatagcaacgggtgcatcgtacagcacctcggcagcgggggcggggtactggttgcttcagatactggataatgtgacgccttcccactggactgcgattggtgtgctggggagtttatttttagggcttctgacgtacctgacgaacctgtatttcaagattaaagaagaccggcgcaaagctgcgcggggagagtaagctgatgagcaggaaactccactatggtttatcggtagccgttctggcgctgattgcggcaggtgcttctgcgcctgaaatcctcgaccagtttcttgacgaaaaagaaggtaaccacaccacggcataccgtgatggtgcggggatctggaccatctgccgtggtgccatcatggtggatggcaaacctgtcgtcccgggcatgaagttgtcgaaggaaaaatgcgctcaggttaatgccattgaacgtgataaggcgctggcatgggtggagaaaaacatcaaattgccactgactgaaccgcagaaagcgggcatcgcgtcattctgtccgtacaacatcgggccttcgaaatgcttcacctcaacgttttaccggaaactgaacgccggagaccggaaaggtgcatgtgctgaaatccgccgatggatatatgacggcggcagggactgtcggaatcgctcaaataactgttacgggcaggtatcgcggcgtgaccaggagagcgcgctggcgtgctggggaattgacagataagcagaatattttgctgaaaaatgcggtttgctcacacggacggataacacgaaatcctgcgaactgacaaaaactaagtgaataaaagtaaaaaccccgtttgttggctgcaagcggggttttgtgtttctgaccttggataaggcaagggagaacatggaaaagtataaacgaattctgttgaggttgactatgaaaaacggccttgaactgaaagcgcctgtaactgatgacatcagcagagcactggcttttgccattaagtgggtggcggtcggtgttgctgtgtccccgatgctgtatgggctggcaaaactggtcattgcgttgaaatcgtgaagggaggattaagcatgtcagacaaactcataacgctggcgaagatcctctgtgtaattgtcggcatttcattttcactcatgctggttgccattttcttttccaccgcctggcgagtcctgacgttatcgggactggtggggtgaaagagagatgagccgtgttctgtgtgtggtgattattgtcctggcgggtggctgtggtgcgctgtggctggcaacagaccattaccgcgataacgccatcacctacaaagcgcagcgcgataaaaaagccagagagctggagctggcaaacgccaccattactgatatgcaggtgcgccagcgcgatgttgctgcgctcgatgcaaaatactcgagggaattagccgatgcgagagctgaaaatgaaactctgcgtgctgatgttgctgctggtcgtaagcgcctgcggatcaacgccacctgctccggtaccgtgcgtgaagccaccggcacctccggcatggataatgcaaccggcccccgactggcagacaccgctgaacgggattatttcatcctcagagaacggttgatgacaatgcagaagcagctggaaggggcacaggaatatatccgcactcagtgcctgaattaacagagccagcttaatcgctggctttttcatatctgaatttcatcgcgcatctcacgcgcatatcacatccccgagcctttcagaaagttgagcctgagaactgccgtatatggtggcgaccatctcggggcggcttttctgtgagacaggctcaattttctgaaaggtaagacgctatgaactatccgacgattgttaacggtattgatttccgcgatcttgtttttgtgacaggcaacgagccggtgacggatacccgaaaggttgccgtagcatttggcaaagaacacaaagatgtattgcggaaaacaagagccgttgttcaacaatgctcaaaagaatttgcagagcgcaattttgcgctttgctatgaaaacaatgagttacagaacggtaaaccccagcccatatatcgaatgacaaaagacggttggacgatgttggtatttggttttacggggaaagctgctatgacctttaaggaagcgtacattcaggctttcaactggatggctgagcttattcagcaaggtctggcgaatctggaggcggagcgcaacgctgtaatgctggagtacatgaaagagaaagatgtcgccagtatgtcaggtcgtttgctcaatcgctggggcagggtgaagaagcctcagttgctggcaaggctggacaggctggagcagcaggggcagattgcgttacccggatttgataaaggcatttcagcctgacatagccatgcgccgtatcgtcgcagtattcccgcattaacagagacctcagccagacactggacctcctgcgcgagtgtgtggggataatcaaaaacgatgcacaccgggctttccacgttttcaggtaacgtgagcgttttcccgcatggccgcctgtccggtgcggtggtggaagaaaccggataaaacaaccatattgtgtaaatatcaatcaaacaagacgctgctgtgtgaattctgaaaaatcacagcggtcattatgcgtcagtttttaacagaggacgtcagaaagtgacatggcaaagctggactggaaaaaactggagcaggcattccgacgcgaacatgccgaaacgggaataacattactggagtggtgccgtaagaaaaagattaattacaacaccgccagaacccgtataaaaatgggcaaaatcgatcatgaaatcgatcatgacatctcagatgaagaacccagcaatgacgcgggttccgacgatgaaaaatgcgcaaaaaattctgaaaaaaactgcgcaaattcggcagaaacgaaacgcaacagcagatcgggtaatcctcaccccgttgcccggtttagcgaccgtaacacccacgccgtgagacaccgtggatatgcgaagtatcttgaggcagataacctcatggatgatgcgtccgatatggtgctgttcgatgaactggtgttcacccgtgcccgcgcactttcagtaacaggaacactgaaaaaaatgttcgccgacctgaaagaggcggctgacgtggaaacccgtgttgccctgtacgacaaaatactcaaagcagaacaggcccttgaccggaatattgcccgtatcgagtcaattgaacgctcattgctgacgctggacgttctggcggaaacagcaccaaaacttcgtgctgaccgggaaagaatcaacgctgccagagataaactcagagcggaaaccgatattctgaccagccggcgtcggggcgttgttacgcctgtcagtgacatcgtgtcatcgctgcatgaaatgagtaattcggggagactggatgacattccggaagaatgaaccgcgatgtgatgaaccgtcagaaatgaccgggaccgaacaacgtctgttcatcatgactaaactgagcaatccctggtggcggctcaatcatctctacaaaatacagaacgaaaaaggtgagctggtcaccttcagaatgcgaccggcgcagcgccagttgttccggagcatgcacaataaaaatattatcctgaaagcacgccagctggggttttccacggccattgatatttatcttctcgaccaggcattattcataccgcatctcaaatgcgggattgtcgctcaggataaacaggctgccagtgaaattttccgcaccaaaattgctgtaccgtttgatcatcttcctgactggctgagagcctcattcaccatcgttgaacgtcgtagcggagccagcggtggctatatcctgtttggtcacggctcgagtatccaggtggcaacctcattccgttcaggtacggtgcagcgcctgcatatctcagagcacggcaaaatttgcgcaaaatatccggctaaggcgaaagaactgcgaaccggtacacttaatgccgtctctgatgagtgcattatctttgatgaatccactgctgaaggtgtgggtggcgatttttacgagatgagtaaccgggcacaggaaatcactgcatcagggctggcgctgacgccacaggattataaattccatttttacgcctggtggcaggatctcaaatacagcgccagagtgccggaaagcggacttaagctgtcacgggaaaaaacagcgtatttttctgcggttgaaaaagcaatgaacatcacgcttaccgatgagcagaaacactggtacatctgcaaggaaactgaacagcgtgaggaaatgaagcaggaatttccctcaacgccacaggaggcgtttctgacgtcaggacgacgggtgttcagtgcggaaagcacgctgcaggcagagtcattctgttcgccaccgctgattgtttatgacattgaaccggttacaggaacgaagaccaaggcgcagtctctgcgtgacgggaataaagccgaacagcaccggacgctgatgaattatctgctggtctgggagctgccggatccggatgaagagtatgtatgcggagcagataccgctgaggggctggagcacggagaccgctcatcgctggatatcatcagatgcagtaatggtgagcaggtggctcactggtttggtcatctcgatgcggagcttttcgctcatctcattgcgcaggtctgccgtatgtacaacaacgcgtttgtggggccggagcgtaacaatcacggacatgccgttatcctgaaactcagggaactctatccgacgcgttatatctacaacgaacagcaccttgaccaggcatatgacgacgatacgccccgtcttggctggctgacaacccgccagagtaaaccggtcctgacagagggaatgaaaacgctgctgaataacggcctgtcggggatccgctggtcgggcacattatcagaaatgaacacctacgtttatgacgcgaaaggctccatgaatgcacaggaaggctgttttgatgatcagcttatgagctacatgattgcccaggagatgcgcgccagaatgccggtgagggtaaaacagaaaacggataaacgcagaaccacacactggatggctcactgatgaaaaatgaaactaataccatggcgacgaaaaacgacaacggagccacgccgcgtttttctcagcgccagttacaggcgctttgttctgatattgacagtcagcctaaatggcgcgatgccgcaaacaaggcctgtgcgtattacgatggtgaccagttgccaccggaagttctccaggtgttgaaagatcgcggtcagccgatgaccatccataacctcatcgcgcctaccgttgatggtgttctgggtatggaggccaaaacgcggactgatctgttggtgatatcagatgatcctgatgatgaaacagaaaaactggctgaagctattaatgctgaatttgccgatgcttgccgccttggaaatatgaataaagcccgttctgatgcctatgcggaacaaatcaaagcggggctcagctgggtggaggtcagacggaacagcgatccgttcgggcctgagtttaaggtgtctactgtcagccggaatgaagtgttctgggactggcttagccgggaggctgatttaagtgactgccgctggctgatgcgccgccgctggatggataccgatgaggcaaaagccacatttccgggaatggctcaggttatcgattatgccattgatgactggcgtggttttgtcgataccacggttactgaaggccagcccagtccgttgatgagtgcatgggaagagtatcagtcatgggatcgacagcagaacgaatggcttcagcgtgaacgccgtcgtgtgctgcttcaggtggtttattaccgtacattcgagcgtcttccggtgattgaactcagtaatggacgggtggtggcctttgataaaaataatctgatgcatgcggtggctgtggcatccgggcgggtgcaggtgagagtcgggcgggtaagtcgtattcgtgaagcctggtttgtgggaccgcactttattgtggatcgcccctgcagtgcgccgcaggggatgttcccgctggttcccttctggggataccggaaggataaaaccggggagccttacgggctgatttcccgggccattccggcacaggatgaggtgaattttcgtcgtataaaactgacgtggttgcttcaggccaaacgcgtgattatggacgaggatgccacccagttgtcagacaacgagctgatggagcagatcgagcgtccggatggcattattaaactgaatccggcccgaaaaaatcagaaaagcgttgctgatgttttccgggttgaacaggattttcaggttgccagccagcagtttcaggtcatgcaggagtcggaaaaacttatccaggacacgatgggggtttattccgcatttctcgggcaggattcaaatgcatcgtccggtgtggcgatcagcaacctggtggagcagggagccacaacccttgccgaaatcaacgataactaccagtttgcctgccagcaggtgggaaggctgttgctcgcttatcttcttgatgacctgaaaaagcggcgcaatcatgcggtggtgattaatcgcgatgatcgtcagcgtcgccagaccattgtcctcaatgctgaaggtgataatggtgaactgaccaatgatatttcaaggttaaatacacatattgcgctggctcctgttcagcagacaccggcgtttaaggcacagcttgcacagagaatgtcagaggttattcaggggctgccgcctcaggtgcaggctgttgtgctcgatctgtgggttaatcttctggatgtgccgcagaaacaggaatttgtcgaacgtattcgtgcggcgctggggacgccaaaatcaccggatgagatgactccggaagagcaggaagcggcagcacaacagcaagcgctggagcaacagcaggcagaacttcagatgcgcgaaatgacaggccgggtggctaaactggaagcagaagctgccagggcacgcgcggctgcgcaacgggataatgctggcgcacaacgggatgtcgccgcggcacagggacagcgttatgtggatgcgcttaaccaggcacatacggcagaaatcattaccggcatacagaatatggaacaggagcaggaagttcttcagcaacagatgctgcatacactacaacagcggatgcatgaaatgccgctctgaaaatcctgaacttaacggaaccccgtcatcgtacggggttttttgtttccggagataagcgttccgggagcggtgcgcttattcgcgggggcagcgataagccttatttactcaaccattcggatctgtccgataaacagaccatgcggagttatttatggattttgaatttacgggtgaagaaaccccggaacaactggaaaaaatgctggaagggcttggggatgtggatattgacggtcacgaacaggacggcgtgacagaggccgccacagaaaatcatgcggatgaggcagcacagacacagacgggcgataacactgcggcaccgacgccggatgccagtgctgagcagacgcaggacgtgaaggagccggaggcgaagggtgtgctcacccgcgatggtaaacacgtcattccctatgaagtccttgaggctgaacgttccggtaagcagcgggccgaacaggaagccgcacttcttcggggacagatagccgaagaaaaacgcctggttgaactgctgacgtctcagatccaccaggccggtatgaaacccgcaccgttaccggaaaacgaaaaaatctctgatgagaagattgcccgtatcagggagatgtatccggaaattggtgacgcggtggcttcgctcatccgtaaaaataactatctccagtcccgtgttcagcaatcagcacagcaggcagaaggtcatggtggtgaggatttatcaccggttcttgatgcgatgaatgccgtgccggtgctgaaaacgtggcagaactccgatccggatcgcttctcggttgccgtatccatcgacgggaagctccagaatgaccccgcatggaaagacaaaccgctcactgaacgtttcgccgaagtggcccgccgtacgcagctcgcttttggtgaagccagtgagccgccttctgatgacaaggcagacaacacggatatccggaaaacggcggaagaaaaagtgaaagccgctgaacgggagatggcagtgcctgcttccccgtcagagcttggcaacacggcttccgtcggaaccggtgataattttgaacggttacttggtgcttcccataccgaaattgaagccgccatgcgaggcatgacggacgctgaaattgacgcgattctggaaaaactcgggtaaccactgaaggagtactgacgtaatgaccacagtaacaacagcccaggcgaataagctgtatcaggtggcgcttttcacggctgccaaccgcaaccgctcaatggtgaatatactcactgaacagcaggatgcaccaaaagcagtttcgcctgacaagaaaagcacgaagcagaccagtgccggtgcaccggttgtgcgaatcacggacctcaacaaacaggccggtgatgaagtgacattcagcatcatgcacaaactctctaaacgtccgacgatgggggatgagcgcgttgaaggccgtggtgaagacctcagccatgctgatttttccctgaaaattaatcagggccgtcacctggtggatgcgggcggacgtatgagccagcagcgtacgaagttcaacctggcatcctctgccagaacgctgctgggtacgtactttaacgacctgcaggaccagtgtgcgatagtgcatcttgccggtgcccgcggtgattttgttgctgatgacaccattctgccaacggcagatcaccctgaattccaaaaaatcatgatcaacgacgtactgccgccgacgcatgatcgtcattttttcggtggggatgcgacgagttttgaaggtattgaccagtctgacctgttcactcttgcgctggtcgataatctctcactgtttattgacgagatggctcatccgttacaaccggtacgcctgtccggtgatgagctgtatggcgaagatccgtattacgtcctctacgtcacgccgcgtcagtggaatgactggtacacctccacgtccggcaaggactggaaccagatgatgacgcgtgccgtaaaccgctcaaaagggtttaaccatccgctgttcaaaggcgaatgtgcgatgtggcgcaatattctggtccgtaagtatgcggggatgccgatccgtttctataaggactcaaaggtccttgtatcgaaaaacgatatggcagcaaccacagaggagatgcaggccaagaccaacatcgaccgtgccatgctgctgggggctcaggcgctggcgaatgcgtacggccagaagggcggcggtcacttcaacatggttgagaagaaaacggatatggataaccgtactgagatagcaatcagctggatcaacggtctgaaaaaaatccgtttccctgagaagagcggcaagatgcaggatcacggtgttattgccgttgataccgcagtgaagctgtgatttttcctttccccatgccgggttatcgcccggctttttcaggagtcattaattatggcaaagactatccttgctccgtcactgagtgagcgggtttattcaggtacgcatggtaatgagtcggtggcagaaggtgtgtttacagtgaatgctgccgaacaggaaaccgttattaatcttctctcactgccgactggcgttcgcattaatgggatccaactgatttcaaaaggtggtcttggtggtacggcgaccgtcagcgttaaatctggcaagcatgagctcattggtgacagtggtgcagtaactgccagctttgctaaatatgtgccagtggagccgtacaccacacagagtgatggagagctggttacggtcaccattaagacagctgctgcgaccggtaccctgaatgttctgctgcgttataccgtggtgggatactgatataaaccttccggcccgcgtcatgcgggcttttttatccggggaattatatgagcgagaaaattgccgttgtctatatcggccccaaacccgtgaaaaaggatacccttaccgggagtcgtacactgttcccgcgtcttgagccggtgcatgttgacagcgcgcttgcctggcagttgctggcctttccggatgtctgggttcgtcatgaagagcttgatggtgtgctcaaaaagcaacaacaggatgagcagttgcggcaggcacagcaggcgcaggaaagagaacaggttgctcttgcagaagcggagaacagttttgtggttagcgttggtggtcaggatgtggatttgagcaaactcacgtccgcacggctggcaacgttgtgtgaggcagaagagctgaatattcacaaagacccgaaagaaacggctgatgcatttcgtgtccgtgtgcgtgaggcatttcgccgtcgtgttgcggagactgaacagcatggcggaactgactgattttttaccgtatgtccgtcgccatatcagtggtccgctgaacattatgatgacggatgcgttatccatgtcggcagtggcattctgccgtcagtccctgttgtgccgccgtgaagccacgctgtcaccgtcagccggagaggactgtgtgctgccatatgatgcggagaatgaagagtgcgtacatattattcgtatcctcgctgacgggcgtgagctttttgccggtcatgatgtggaaatccgcccggggcgggtaatgcattttgcctgttcgcccggagaggtgagtgtgctttatgccgttgctccgaaagcagggagccgtcaggtgcaggatgaactgcgggcatggtctgaagaagtggctgcaggggcgcttgaacggttgttcatgcagaccggggtttcatggtcagacccgtcgcgcgcacagtatttctctgtgctgttttctgagggtatccgtcgggcatatcgcgacacactggcgacaagtccgtactcctcataccgcaatcctgtccgcagacaaaggttttactgatgacgacgattactgaaatcatcggacgagtgaacacgcaactggttgacccgatgatggtgcgctggcctctggctgagctgtgtgattattacaatgatgctgtgcgggcggtgattctggcaaggccggatgcaggcgcaagtctggagacgctgaattgtgttcctggtgcacgtcagactttgcctgatggcgcaatacagcttcttgacgtgatatgcctcagcgatggcagtgctgtaaaaccgcaatcccgtgaggtgcttgatgcacagtatcccgactggcacatgctgagggggaaaccggaatgctttatcagcagtgatcttgccccgcgcgtgttctggctgtttccggcaccggaggaggctgtgagtgttgatgctgtggtcagccgcattccggaggcggtgtatgttctgacgcaggatgatgacacgcctgtaccgctggaagaggcttatgttaacccgctggttgactggatgttgtttcgtgcattcagcaaggatgcagccggtggtgcagagtcaggactggcagcacaacattatcagagttttgttgagcagctcgggattaaacagggtgcagacagtgcattgtctgcccgcaagaaggtgtttaacggaggtggaatgtgagtgttgttgtttcggggacgctgaaatctcctgatggtgaggcgatatcaggcgcaaatattaccctgacggcgctgacagtttcaccggatgcgctcagcggcaccagtgcgtcagcagtgactcgtgacggcgggtattacggaatgacgctggagccgggggagtatgcggtttctgtgacggtgaaagggaagactgctgtctacggacgtgtgcgtattgaggggactgaaagtacggtgacgctcaatatgctgttacggcgtagtcttgttgaggtgagcatacccggagaactgctgacagatttccggcagatacagaacaatgtggcggatgaccttgccacgattcgtcgtctgaacgaagacacggcggtgaaaaataatcaggcttcacagtcgaaggaaagcgctgctgccagtgcgaagactgcatcagaaagcgcgaaggctgcgacaagcaaagcgacggagtctgcacaaaaagccagtgaggctgcagaggcggcgacccgggcaggtgagtctgaaaaggcagcggcagcagacgcgaaagaggccagacaacatgctgaaaccgccagagtggctcaggaggccgccggagacgttcttaaacgtgctgaggctgctacggttagtgctgaagaagccagacgtatggctgagaatgcacgaggacctaaaggcgatacagggccgaaaggtgatgctggtcctcgtggtgaaacaggtccggcgggtccgcgtggggagaaaggtgagcagggagagcgcggacctcagggacctcgtggggagccaggcccggcgggcagcgcagcaaatgtggcagatgcgacgacggcacagaagggaattgtgcagttaagcagcgcaacggacagtgatgatgaaacgaaggcagccacaccgaaagctgtgaaggcggcaatggatgaggccagggcagcgaaacagaaggcagaagaggttgcgacaacccgcccgtcgggagaaagcatacctggaccgaaaggtgacaggggcgagcaaggaccggcaggtcccacaggtccgaaaggtgagcgcggtgaacccggacctcaggggcctgcaggacagaaaggtgagcagggcctccgtgggctgcagggggcgacaggacctgcgggagcagtggggcccgcaggcccacagggaccggctggtgcagctggtcccaaaggtgatgcaggcccggcagggccacgaggtgaaaggggaccagcgggggcacagggtgttccggggccggttggtccggcaggtcctgcgggtaaaacggggccacgaggtttgcagggagaaacaggaagacagggcccgacaggtccacagggaccgacaggtgaaaccggaccacagggaccacaagggccaaccggaaggctggtacccggggaaatttacagcatcggaacatacattattgccgcactaggcccgtatataaccgacatcggcagaacctatcagccaggagaaactgtatcgggttcacgccttaagcgatgcgccctaatcaaagacgaaaacggaaactatatgaaagctaacaccgatggcattgacggcaacctatcctcagttccgggctcatggatggtgtgtaatgaaattacgtcgacaaatgacaatgaaggcatcgggctgttccagcgcgcatactgacagacaggagatgacatgaatgtggaaaaaaataagcaatccgcaatgggcagataaagatcacactgctgtcaattgcatggtgaagtttgagcacattgagcaggcggttcctttcactgcaacagccagcgataccgaagcatacgggcgggatatttatgccgcttgtctgagaggagaggccggtgaaattgcagaatatgtacagccatccatcagcccggaaaaagccagagaactcaaaaccgccgggatcaacgcctggcgtaatgcgatggaagcggcgaactacacgtttgagcacaatgggcgtaaatgggactacgggaagtcaacgcagacgcgtcttgagccgtcggtggcggcagcgaaagcggggaaactgccggaggcgtttttctggacggatgcggacaataatgacgtaccgatggacgctgaaacactgattgctctgagtgctgctgcagagcaggcgatgtttaccaaaggtctggaaattcatgtcagacagcgcacgatgaaaaaagagattgaagcactgggtgatgcggaagctatactggcgtataaggtcggcatggctgacaggtgaaaaaaaagaggggcgctccagccccttgctacaaagctatggctaaataaagaatactcaggtcgaggaaataatctggcaatgataattaaaggagatgcaacggcctccttcacccctgtcaaagataaaaaactggggagtgcgtgctccccgagagcatgatacttgtggttgatagttatttttatccggcgacaaagatattgagatgagggcgcggatgcaatacagaattttcgtattgcatggtaactgctgattcctgaaactgaaagtcgtcatgaaactgtaagcgaaaaaacggggagacggcacgctccccaaggtcatacatgagatagtggtgtttttatagtcgaaagaataattgcataaaaagagtgtaaattaaacattcaggggatacagaattttcgtaggctgagggattgctgaaaataatttagtgcgtccttcaatggtcattcaatggtcatcagattgtgctgatgtaaacagttaagcacaatttgattatttgactttcttctttttgtgactaacttcacaattaaagatgtaaccgtatacaaattgttgatgaataaagagacagaataagtggcaggccagtcgtaatgcggatatcccttcgcggacgtgatatcaccgacgttatagtaaggaaattccgaaaaacttcatattaaaattcggaatttcttcaggagtaagctcatgagagcggcgagacatcagattttctttatatatccgatgttgaactgttttatttgtatacagataattttatagggtataccacatgagcaagaaatttacaaagactattctttcatctgctgttgccggactgatgctggtgagttctggggccatggctttagatatcccagttaaaggcagcgattacatcgtaaaattttacaaggatggggaaggtgccaagatagtagacgcacaaggaaaagaggttttaggtgctattaatacaacaacaggaagcatcatggcctttaatgaaaaggagtttactaattttttagcaacacacggaaaaacacttgataaaagtaaaatgcaggattatttaaattctattgcgtatcctgtctacttacctgagttaaagctggaaaatattaaaaagttaaagggtacagacgttgaaaaaataaaaaaagttaaggatgatgtatccaagattattacctccaaaaccgcggccgattataaccaggctgtaaaaaatggtatgagttctgaagctgcactgactgtagctaaagatggtggtgcagtcttaaaagaattcaaccgaattgattcggatatcgaccaactgaataaagagacaacttttgcgcttgatgccgatggcaatatcacgctggatgaaaatcagggaagcggtgagcgttattctgtaaaacaaacagtcgcagatattaaggctgacactactgtctaccagaataaagatggcagctatacacttgaccagagcgcaccgggcaacgttcgtgtgaatgatgctgttgtcagcctcgacaacagaacccgcagtaacacccaggctatccagaatcactcccgccagctgcaggagcataacgcacgcctgaacagccagcagcgccagattcgtgaaaaccacgaagaaatgaaacgtgcggcagcacagagtgcggcgctgtccggtctgttccagccgtacagtgtgggtaaattcaacgccacggcagccctgggtggttacagtgacaaacaggctgtggctgttggtgtgggttaccgcttcaacgagcagaccgcagccaaagcaggtattgcggccagcgacggtgatgtttcctacaacgtaggtgtgaacttcgagttttaattgctgaaggtgacatgaagtatgacggcaggcgcaggactctggtctgccgtttttcatggggcataaaaaacaggaaggtgctgcgatgaaggtgattctggctaccaggaatcgctatctggagtatggtctgcaggcgttactgaaggggcacagtgtgatactggcgagggagtttttcctgccggagaaccgccgttatatcccggactttgacgaatcctggctgataatcagtgatggcctgctgggcaggctgatgcggtgtatgttccaggggcgtcattttctgcaactggatgcggagttgctccgtgatggtgagcagataagtgatgccatacacaacggcgtctggacgtataacagtgctgcccgcccgctgacgatgtcagagatggtggtgatgttcggttatgtctaccgccagtcgagaccctgtcgccttgccagtgaaatgggtatccacacgaagacggtgaatacctttctgtatacgggaatggcgaaaaacgggctgtatggtgtgagcgtcagacggcttgttggtgcctgatggcggtcctgccggatgcgcagaatcttctgatagttcagaaggtgcagatgatgaataaagagagatgccggacaatcggaagaaaacgttacaccacaggcgcaatgtgcttcatgctgtttgtgtggcttggtggtgtgctggctcttgttgctacagctgcggtggtaatgcagtaaaaaaaggggagcaacatgctccccgaccagaagaaagacgtttgataacaattagtgagttgttacgtcttgtccagaatatcatagcaacactctgttgcagtgataccgatcgcgattttagcgaattccatcataaatcccctgatttttaagcctgaagcagtcaaaggaatttctatgccctatatcgatatcaccacgatgcgtgggatgatgccgcgcgttgtgacatccatgctgcccgagcattccgctgtactggcggaggactgccatttccggtttggtgttattacaccagaacgtcagatatccggggttgagaaaacattcacaattaagccaaaaacaatttttcattaccgtgacgatttctggtttgcatggccggatgtggtggatgtgatccgcagtccgatcgctcaggacccccacgggcgtatttactacactgacgggcgttttcctaaagtgacggatgcgaccattgccacaaaaggggacgggaatcacccgacatcatcgtatcgtctggggatccccgcgccgacgacagctcctgtctgtactgttcagcagggcggtgatgtttctgacgataacccgaatgatgatgaaacccggttttatacggaaacctttgtctcagattatggtgaagaaggtccgccaggtccggcgtctctggaggtaacactccgtactccgggaactgcggtacaactgacgctggctccggtgccattgcagaatgccagtattaaacgtcgtcgtatttatcgttctgcatcaggtggaggggaggcggattttttacttgtggctgaactggatgcatccgtgctcagttacacggacaaaataccggcgaaaaaccttggaccttcgctggcgacatgggattacctgccgccgccagagaatatgacaggcctttgcctgatggctaacggtattgccgccgggtttgccggtaatgaagtgatgttttcggaagcgtatctgccgtatgcatggccggaagtgaatcgtcacacgacggcagaagatattgtggctatctgtccgctcggaacatcactggtggtggcgacaaagggtgagccttatttgttcagtggggtctcaccgtccacaatttctggttccagaatcccttcaatgcaggcgtgtctgagcaggcggagtatggtcgcgatggagggctttgtgctgtatgcaggaacaaatggcctggtgtctgttgatgcaaacggtaatgccgctctggcgacggagcagattatttcgccggaacagtggcagagtcagtttaatccggcctccattgtggcttatccctggcgtggtgaatacattgcctgttacacgaaaccggatggtaagcaggatgtgtttgtcttcaacccggcaggtatggatatccgctacctcagtacaccttttgactgcgcatgtgttgacctggttaacgatgttatgcgggtggtatcaggacaaaacatgtctgcgatcgccggagggagtttgccgtcgacaatcagatggcattcaaaggtattttcccttccggaaagaacctctttctcctgtctcagggtgaagtctccgacgccagagcgggtgggaattactgtgctggcagatgatgttccggtgattcaccttgcacctggaagcttttcgggaagcgttgtgagattacctgctgcaaccgggcaaaactggcagatactggtttccggttttggtcaggttgaacgtattacactcagtacatcgatgtcggagctgccggtatgacaaaaaaaccgtggcgcgcaggaaaggatttatctgcggttgtggaaaatatggagatagggacaggacaacgtggcgatggtcgtcatgcttttgtaacccgtgaagaactggtcggtctgaagctggcccgtcgccggacttcaggtggtgccgcatatgcccttaatccggggattgagatggacagctctgtaatggtcgttgatttcccatcgaaacctcagaattttaaggcgacagggggatttggctcggtactgcttgaatgggatatgccgaattatcgcggtcattcactgactgaaatctggcggggtacggaggatgacctttcggatgcggtgctggttgccacgacgccggggcaggtttacggtgatccggttgatccgggctggtcgggattctactggatacgctttgttaatgcagcgggagtgaaagggccatggaacgcggtaaaaggcactcccgcacaaacccagataagcgttcaggccattattgaccagatcaaggaggaggctgcaaagtcaccggtggtggaagagctgcgtaaggaaataaagaatgctcaggggcaggcagtaaaggacgcggcaatcgagacgacggaagttgtgggtaatctcagggaagaaacactgaaaactatcggtggtattgatacccgtgttacggggatgaataagtcaaccagtgaagagcttaataaggtaaatgagcgcatcactaaggtggataaagaaggcggtgaagctttcctggccatgtggtcaaaaaagaccggtgttgagggaattactgcggggatcggaattgttgcaggaaaagatggtgaagggaagccggtaagccaggttgcaatttcggcatcgcagttgtttgtctttgacccgaacaacccggataacacagcctatccgtttgcggtatcaggtggcaaggttgtgatcccgaaagcgatgatttatgacgcggtgattgaaacactggtgtcgcggaaggttgtggcggatgaggtaaaagcaggggtaagtatcacgtcgcctgttatccggagtgctgttattcagaacgggaactttcaggttgattctcagggtaacctgaatattggtggcctttttagtgttacgtcgcaggggcaactgacaattcgttactctaatcagaatgtggggctggtgatccgcaatgataaaattgaagtttatgaccagaacggacgcctggctgttcgcataggcaggttaagctgagccggaggctgacattggcagaatatggttttgcaatatacaacagaaacaatgttaatgttacgggcgtgcttactcccatatttttcctggacaggtttacggcggagtcgggatcaaaaacgtatacgaataaaccagaagggaaaacattgcaggcagtctgttcattatttccgtggaataatgtatttaaggaccggaaagtaccgaagataaccattaatggcaatacggtgacgtggtcgaatcttgagcaggggatggggtcatatatttatacattctgggggtgagttgtatgtatggtttaagcattacgaaaccagatggcagcttgtggataagcccggggtttacgcctcagtgtctgatcaataagggaactattccggcgactgagaaggctttttttaaaacatcaatcccgtcaggaaaaagttgttttttctttatcagaacagagaaaaaggccgatgtcatgtacacacatgaacagattgatggatatcatgccttaaggcttcatcaaattgtcaggggaacgaatcctggtgttacgactgtttatgcttttgcgaatatggttactcaaccttctgagtatggtattgccatgtataacccgtcgggtgagatgatttaccatggcgaaatgatgctgcttgacgcgaagttaatacctgttgatatcaaatttgaaaaagacctcggatatccatgtgcaattatgcctgcactggttgggtattataactggcagcgtacaccttatgaccgaccgatttacaccacatcaacgggggctacaggaaataaaatatattcctgtgagcattattccggtcgtgcaacatgggatattcggaagccgtatatagataaagtgttggtcattaattcatcaatatatgactgatatgcctgtcagtatgaatattaagtaataaaactaaattcatcttagataatacggggttattttattataggaaaagtctaaaaatgaaacatgccagaattatttttgcgtgcacaacttttgtgatgagttttgtagcagcccctgcctgtgcagcacaaggtgacagtacagtttctttcggatacgctcatcttcagctctctggactgaacaattttgttaaggatttaagtctttataatcttgatacttttaaccgttttacaaacagacactacttcaattcaggcgaatatgcagatgcttctgtccgggggcatgatggcaaaggcaaatctcctcaggggatgagcatcaggtatcgttatgagataacggatgagattggtgttataacatcttttacatgggcgcgttctatgactaatgcgcaggcatttattgacattaacccaggagatgaatccagagaggttaaaaatccggcagcttcagcgagaactgatatcagggctaattactggagcctgttagcgggtccttcgtggcggtttaacgaatacctcagtgtgtatgcaatggctggtatgggcgtagctaaagttaccgctgacctgaaaattaaggacaacattaacagtaccggtggattttctgaaagcaacagtacgaaaaaaacagcacttgcatgggctgctggtgcacaatttaacctgaatgaaagtgttgctatggatgtcgcgtatgaaagctccggatctggtgactggcgcacgagcggggttgttgtaggtattggcctgaaattctgatctgtatccgacaacatgtcataacccgctgtgatggcgggttttttgttgcccgtgcagggcaaaaatcgtagattatgcgcgggtgcctttcggctgatggctggaaggtgaacctgaaggcctgatgtggaaaggccccgagtcaactttaatgttaacccgaggccctgaccgtacaaccttcacaagtagtaggttagcgcctctccactcaggagacaagcgttatgtcgcaaaaatcgctcatcaccgtcacaatttgtatgacggtaatcttcaccatctggatgttacacggctcgttgtgtgagttccggctgaatttgtggggagcggagtttgcggcgttcttacagtgtaagcagtaggaaaaccgcgacggggacgaaagtccccgtcaactggttgctgaggttcagccgatatggcacccgtttcaggtgagagaatggacgacagaattctccggtatatgcagcgtgttgtgagaaattcccgcaaccctgaatttatgaatgaagttaaagacgcctgccttaaaaagcaggcgttttgctttgaagcgccggatggttttctggtgctgcgttctgtgctcagtgacgatggtatcccttatgttctggtgttactgggcgtgtgtacggggagtaagagtgttgagcgttatctgccggaggtgaagacattaacccgcctggctggcggacgctgggccgaatttcatacggcaagacgaggatttatccggctgggaaaacgtctgggctttgagcgaatgccggatgatgaggatggcttcatggtgttcaggatagcagtctgactgccactgtattcatcatcgagcgtaaacccacattgcaattcacattctgaccctgctccggcagggttttttgttatctgaggagccattatgggcggaagtaaaggtggtggtgataccaaagtaaaaccaacagcagcgcaaatagcacaggaagaggtggcctggaaagggtggcaggattacaaaaatattctccgtccggcagaagataacttcatgaaaaaggtcgatgaccttaacagtgagcagcagtacgaaaatatcgcaggcacaacaaatcttgggtatcagaaacagtttggtgaagcgcgaagggagctggcgggtaatcttgctcagtccggcgttgacccatccagtggtcgttttaatgcagtaatggatgcaaatcaaagcgaccaggtgatcgggcagattgacacgaccacacgggggcaggtatcgcaggcagataaatatattgccgggctacaggatgttgcggctctcggttccggtcagaaggcagatgcgttacagagttttaactccctggctgacagcagtctggcaaaagccaaatcggatgcacaggcggcgtttacgaaacaacaggggcgagcttctcttgttggcgctggtctgggagctgtaggtgcgtacgcgatgcataaggctggcggtaacggaggtggtggcggcgctaaaacgccaggcaccggcgctaatgctattcagcatcaggctcagaactggagactgtaattatggagtatggcaaatacgaaactctcgcaagggctggttattcaggcgcagcccgcccacagggtgactggcagacatccgccgcgctgacacgccagcaatacgacgactggcgaaccagatatttgccccgcgtggcaaggctggctgaccttggcgagaacaacagcctgatgaatgcacagcttgcccgggtaggtggccttgccacttccagtctccgtacagcgcagatggcacaggataaccagatggcgagatacggggtaaaccgtccggataatcccaacagtaacacgctgggtttacgtaatgcactggcaattgctggcgcgaaaaatggtatacgggaagcagagcaggatcgccagatgaacatactgacgggggcttctgcacctgcaagacaacaactgagtgttggcggaaaactggtgtcagcgtaagggggcaatatgggatacggtttactggatattgcgaatcagtcgcggcgtgaggcattacagggaataagtgatgccgacagacgacgtgaagaaattgaggccgcgaacaaacagatggcggcgcaacagaaagcgcagaacaaacagaatatcggcacgggaattggtacgggtgcagctatgggcgctgctgttggtggtctccccggtgccgctattggtgcagtcatcggtggtcttgctggttcgttgttttaaggagtggtgaatgagcggatttgcacaggggttacttgccggattcagcaccgttgaccaggcaatgacccgtcgtaaggaacttggtttgcgagaagcacagcttgctcaacaacagaaaaataacgagcgcgattttgaatttgcacagtcgcagtttgaacataataaagacgttgatcagcgtgactttgattacaaagccaaagttgatgaccgtgattatgcgcttaaagaacgtgaatttaacgccaaccagaattaccggaatgcgtcgctgggtatggagcagcagcgactccggatgcagaaatacaaccagcgacggcttgagtataacgatatgctggcgcgcgatcagcctgtgatggcggcgcttggaaaggctgtggatgctggcgatcgggatgcagcaatgcgtctttacggccagttgtcagagggtaatccgctgaggctgatggcgaatgatggctatgtagcgaaagcgggtcaggccgtgaacaacctgcaaaaaatctttgatgacaagccggacagggctatcgcttcacttaatacgccggagaatcttgatgtcctttccggggtgtttggcccggaactgcaacagcgtattggcatgcccgattcaaccgggaaaaagacgataaaagaggccaggattggcagtatagtaccggcacagcaggaagggtacgtacttattggccttgatctcacatacagcgatggctccaccgcgcataaacctgtaacagaatacggcagtgcacatcctgatgatcaaaccgtgctggcggtgcctgttgataaggctgttgagcttgtcagggatcgcagtaaattcgcggaaatttcgaaaaatttcggctatttcacgccgaagcagcagggactttctgcggatcaacttcagaaaggagccagccaggtagcgataaaggttgcacaggacggcggtgatgcgcagggagcagtgacgcaatattatgcttcgatgggactgccgcagtatcagcagcaaattcagcagcaaaaaattcaacaagggattaccagttgggcgggtgatgatccggataagcaggcatttgccagagaagtggcctcccgtcagccagaaatgctggagcctcagaatcagaaattgctggaacacgggtatgcgaattttctccgtattcaaaaggccaggggggaacaggccagggatgatagcgcggcctctgcatctgagtttatccgtggtctgaaacagaattacgcgcagtaattcaccattcccgttaatactatttcctgatacccggtcattgtgccgggtttttttatggagtctgtatggcttattccgatgaacagcgccctgaagcgcaatttggcaaccagagccgcaacagcctgaacattcagcagccgggagagactgacagctatgatgtgtttttctccgatcccaatcgctggaaggacaacagcacgtcgttcagcctgggcgatgtattgccaactatggggaaaggtgtcgcccagtccgtccgggggacaggggaaatggcccgtggactcggtgatgcgatgattcagagcccggtaaaaacaggggcgcgtattttaaatgagttcagccgtatggggctgccgggagtcgcaactgttcaggatatttttgtcggtggcagcaagggggcggatgaggtcatcgacactctgcctgatggaaaaaatgcggttactgatactgtcggtaaaggtctgaaggtcacaggcaaggcagtcagtggcggcgctaaagcctcggatgaatggctgactggcaagatgtcgccgggggcgcagcgggcgctgaatacaccgatgactgaaggatatgatgattctgcggtctgggtggcgaagggcgtaaacctgattggtgcccttgtacctgatatggttgcaggcgatgtgactaaaaagctgggtgaagtcactctgcgaaaagtgctgaccgccgggctggagaaaaaatacattgcggcagggatgcagccggaaagagctaccgcactggcagcagaagctgtcgataaaaaaatgccggattttttccaggcaggcctgatcacccattcctcagccagcgcacaggggcagagtgcaatggcagcagcagactctgttcttaacgcggattactctgagctggcgaagtccccgaaatttcagcagacgtttttgtcaattgatgcagatccgcagcacgcacagcttactgatcgccagaaaatggatctggcaaaagagcgtgttgccgatgaggtgcgcgcgcagctggcaaccgatcctgaattgctggctgtgaatgccatggcggcaaaactgggcgatgctcagttgtttaatctggcgatgcggggcacggcgaagaccgttaaaagcggcattgtcagaaatgccacggaacaggggacgattaatgcggcgcagggcggctattcgcgttaccaggaaaatatgacgttgcgtgagactgccggaatggatgtatcaccatgggagggggtagctgacgcaacgatcgaaggagccgctcttggtgcagcgatgggcgcaccgttcggtgcggttgccggatatcgtggaaaacgtcaggccgcagaagaaaccgccatgcgtgaggctgaagtcgtacagcagggtgaagcagccccgcaacccgaaccggctgatccggtggcacagcatcgcgaatccatgcagggcatgaatcgcgagcaacttctggaacagtatgctgatgcggatatggcacctgagggagacacgtctgccgttcatcgccgggaagccgccagccagctgttgaatgaactggatgaacaggcgaagcgacaggcggtgatggatgagctgaaggcgaagccgcgccctgaactgcttgaggaataccgaaaactcagccagaaggaagggcgtactgatactgaagagcagcagttacaggcaatacgtgatgtgcttcgccctcagcgggaggccagaccggaggcacagccacagccggaaaatgcggatgatggcgacgggagtatttacccgacggtgcggttccgcgatccggatgaagttcgtattgaaattaacgagagtggtgcgtccagaccagcagaacgcattgaaaaggtgcgtccggacaaccgttatttcacggatgaaaaaagtgctctggggagcgatgttttccgcaatgccagcgccaccggcctgaaaccgtccgtagtgaagaaaggcgagaatcagtatgccgttgaaatggataatcctgcgttctctgaagatgtggcaacggagaccattaacactctggctgacggagagcgtattactgatgctgatccgatggaacagcccgcgttcatgcgtgacccgcgattccgtggttttacgggggatgatacagaagtgcaggcccgtcttgcccgtggcaacgcgccgacggcggaagaactggtgcgttcccagatggctgaaggtgatgccggtccgacagcacaggagttaactgagcgtccacgccttcccgctcccggcgatattcatcccggacagggatatccgttaccgggagaagtggcgcgtacgccggatgaaaatcaggccggacgtggtggtcgttttaccacaaccggtgaggtgaagggccagagtttccagaaaggacgtgcgcaggcaccggaaaatgccgctggtcgccagggggaaatactggagggcgaaccggttcgtcgtggtctgccgtcaccggatgagcagaacgccacagcaccagtgcgtgaaggacttcctgcacctgaacagcgtggggttgatatgccacatcctgaatcactccctcgtatggttcgtgactcccttccggaactggcacagcaggcagaagcacgcagacagaccggggataatcgccagaccataaccgatgttccggatactgaggtgccggtgccggtagataaaccgagcactcaccagcaggcgcgtggtgcaaaaattgaagactttggcgaggagattaagggcgcggcaaaacaccgttatgcacagcttgccgaaacactgggtaaaacgctggaagacagggattatttcacgcagccgctgagcaaagtgttcccgaaaccggactatgcaaaactggcgaacgaaggggccgacgctgacacactggcaatgattgcgctgtaccgcagtgatattcccgcgaaaacgaaactcaatgcggtgaagtgggtggagagtgtaaagagcatccgcacaagcgtggcgggaatgctggaaggaaaagtgactgccggacggcttgctgagtggatggagggaagaatgccttcccgttatgcggatacctggcaactgttacgcacgctgccaccttcacagatggacaaggcttctgcttatcgggtggtatccggtgtgtatcaggcggccggagggaagcgttacgatccgccacagaaactttattcactgcgcaataaggacaataaggggagtaacctctttttctcggaaagcagggatgaattactgacaaaggcgaaagcctggtttgcagagcaggaggaaaagtcacgggtgaaaggtgatgaaaaaacagcaccgtcaccagatgacaaaatcagctttgacgtttaccggaatacccgtagtggcgatatttttatcgcttacggcaaaaacaaaatgcgggtgagaggtggttttaagtcagccagtgatgcgcgtaagtacattgattcacatcgtgatgagcttgttcgtcatgtgaaggagatgcgggagatttcgcgtgaggagcagcgtaacgccactaaccgcgaccgcaccggaccagaacgccgcaaaggggatgtttcgccggagcagttcagtgatgcgtttggtttccgtggtgtgcagtttggtaattatgtggaaggtccgcgtcgtcaggctgatttgaaccgggcttatgactcgctgcatgacctggctgacgtgctgaacgttccgacaaaagcgctttccctgaatggtcgtcttgggcttgcttttggtgcccgtggtaagggtaaggcggcggcacactatgagccgggtgaggtggcaatcaacctgacaaaaggtaacggaccgggggcgctggcccacgaatggttccattcactggataattattttggtcgttatgatgtttccactgacgggaagatcacgtcaggtggcgactatatgacggaagcacaacgtgccgggcgcgtatttaaagacggcagatatgttgatgcggaatatccggtacgtcaggaggtttacgacgcgtttaaaggcgtgatgaaagcgatcaacagcagtgacatgccgcgtcgttcagcgcttctcgatgaggtgcgctcaaaaccgtactggtcaacggatgttgaaatggcggcgcgtgcctttgagcgttatgttcaggataaagcgcgtacggctggcgtggagaatgattatctggtcaatatccgtaaggcacctgagcacaacacagataacacctgggcttatccgacgaatgcggaactggatggcggtattcgtgatgcattcgatcacctgttcagtacgctgaaaacccgtaagacggacaagggcgttgcgttttattcccgtaagggcgtgacccgcacacctgaaggcaatctcatttcggatgttaaccgcagtgcggaagccaaaggcagcccggtcccgcaggttgaagcggttgcccgtggcgtgatgagtggcattaaggacagtgacctgaaggtccgcgtggtgaagtcacagaaagaggctgaagcgctggcgggtgaatcgttcgacggttacggcagggtgcatgcgttctatcgtccggataaacgtgaaattgtcctggtggcggataacatccctgacgggcggaccgttcgcgagaagttacgtcacgagattattcaccatgcaatggagcatgtagtcacgccagcggaatatcagacgattattaagaccgtactgaaaacccgtgacagtgataacgccaccatccgtgacgcctggcgtaaggttgatgcgtcttatggtaaggaatcaccggaagtgcaggcaggtgaatttctggcacatatggcggagaaacagccgaataaatttgtggcggcgtgggagcgtgttgttgccctggtcaaaggggtactgcgtcgcacggggttactgaagccgacagagctgaacgatatcagacttgttcgcgaaactattcgcacgttaggccagcgtgtgcgggaaggttacacgccgcgtgaggatggcgctggcgcatcgtctcagtactcccgtagcggtaagcctgatccgttcaaagtgccggaaggtgagggcgagcgttatcgtgatgaccttgccagaatgatgaagtcgttacgttctggtgcaatgactgcaaacatcgggcgtacgccgccggtattgcgccaccttggcgcaccagatttgccgctggttatctcccgcgacactgtgcggaaggctaccaatggcgtgaaacatgtggtgccaatggatgttatcgagagacttccggaactgatgcacaatccggatgcaatttaccgttccgcgacagaaagaaatgcggttgtgatgctgcttgatgctgtggataaaaatggtgatccggtcgtctcggcagtgcatatgaaggcgacagataaacgtctggaaattaacaaggtggcatctgtttacggtacggaaaacgggaaaaagcagaaaagtatggaaatggctggattaacgctttaccggaaggagaaattaagccgcgataaccctcagtacagtgggctccaattgcccaaagaggagcgttcttatcgcggctctgtagataaaatactctatcctgaagatattcgcaaggggccgtattactcccgtaccagcagtctgacaccggaagagacaattgcatcgcgttttgtgcgccagatgcaggataaattccaggtgctgaaagctgttcaggagaatatccgtaaaactggcgaaaaaatagacgacagtaacaacgcttatatggcggaagaactcttccacgggaaggcggaaaacgacctgaacgtgatgaaggagcgctacgttcagccactggctaaattactggcggactacaaaattgcgcaggccgatctggatgagtacctctacgcccgtcacgcgccggaacgtaacgcgcatatcgcgaaaatcaacccgaaaatgccggacggcggttcggggatgaccaacgcggaggcggcggaaatcatgcagcgtgtgcgtaacagtggaaaacaggcacagtatgaccgtctggcagggattgttgacgatatgctggcccgtcgccgtgagcttatccgtgaggccggactggaagagagcggtgtggtggatgcctggcagaacgcctaccgttactacgttcccctgaaaggtcaggatgttgacggtgtggtgtcactgccccgtacaggtaagggcttcaccatcggcggacgtgaaagcaggcaggccatggggcgtgcatcccgcgcacagtctccttccactcaggcgatacaggatttgagcgaatcgctgatccgcaatcgcaaaaacgaagtgggtaacgccttcctgaaactggtgcaggataatcccgataaggattactggcaggtattcactgatgacaaaccggacaccatgcgggcgattgcagagcgtgttgatccggaaaccggcgaaacccgtcgcgaagttgttgaacgtccggtgcctatggcaatgatggcggatcgctacttcaccaccaaaaaggacggcaaaacttactacatcaaactccatgacccgcgcctgatgcgtgcgatgaagaacatggggccggaaaccagtaacgccgtaatccgtacgctggggaaagttaaccgtttcctggcaacggtgaacacgtcgtataacccggaatttctggtcagtaacttcatccgtgacgtgcagacggcggtgatgaacctgaaggctgagcagggaaggagcgacggtaaactgaaagggctggataacttatccgccctggctgtggtgaaagacagccggtctgccatgtctgccgtatacgccagtctgcgtggtaaaaccctcacgggcaacggtgcgcagtggcagaaggtgtggaaagagtttgttgaggatggaggtaaaaccggctggtttaacatgggtgaccttgaaggccagcagaaggaaatggatcgccttgtatcgctggcgaaggggggatggaaaggccagagtatcggtgcatggaattcgttcctgaaccttgtggaggatgccaacggtgcggttgaaaacgcactgcgtctttctgcctataagcacgcccgtgatgccggtttgtcacgccagcaggcggcgtctcttgccaaaaacatgacggtgaactttaaccgtcgtggtgagcagggggcgctgatgaactcgctgtacatgttcgctaacgccagcattcaggggacggcaaaccttgtgagaacccttgggcaccttaatggtgacggtccgttactggagcgccttcgctggaagaatctcaatgtaccgcagaaaatcgcgcttgcagctgtgggagcgggttatctgcttggctcgcttaatcggagtgtggctggggaggatgatgacggggttaactggtatgacaaggtacctgatcatgtgaaagagcgtaacctcgtcattatgaaatcgatgttcgggggcaaggccggtgagtactggagtattcctctgccttacgggtacaacgttttcttcctgctcgggcataccgctgaaggtgtggcggcgggtgacctgacggcgtcccgtgctgccggtaatgttgttggtggtgtgcttggtgcattcagcccgattggcagtgagacgtcggaaaccttgtccggggcattgctgaaaaacgcagcgccgaccattctgcgtccgtttgcgaatcttgccatgaacgaaaacttcatgggggcgcagatttaccaggagaacatgccgtttggtacaccaaaacctgacagccagctgggaagacgttcaacgccagaagcgtacaaggcgtttgcatcctggctgaatgcgttctcaggtggtagccagtatcgtcccggcgcggtggatatcacaccggaatcgctgaaattctggattgactatatctccggaggggcagggcgcttcatttccaaaaccacggatgcggcggtgaaatcgctgaatggtattgatataccggaacagcaggtgcccttcctggggaaaatttcgggtgaggtgatgccgtatgcagaccagcagaagatgtacgaccggatgacagaggttgcgcagtatcacgcagagctgaagagtctgaccggtgcagaaagaacggcgttcattgacgagaacaacggaaaattgttgatgaacgggcttatgcaggatacccggaagagactgaaggatttgcgcaaacagcgtgatgccatttatgccgacagttctctcagtctggcgcagcaggcggcgatggtgaaatcggtagagcgggatatgaaggttgccgtggatcgctttaaccgcgagtacaacaaaaaagtgggagtggattaacagaaatggccccgtacggaagtgcggggctgattaagaaataaacacacattaacctgtaataaccggagctattaacatatagtcagaaagagtatttcatgtgagacagagagccgatttatgtttaatgaagaaaaagttgcgtaaatggcagcgtatttgctgaaaaaacatggcggatctatgcgcttcattaagctgatgtatctctctgaccgcaaagcaatggagttgtatggttttcccattagtggtgatcattatttctctatgaacaaaggacccgttttatcgcagacatattctttggttaaggatggaagtgaaaacgagtacagtccgtgggaatcatggatatctgatgtagcggatcataaggttgaaatgtggcgtacattttcttctgttgatgagctgggggagttatcgcccgcagaaatagagtcaatggacataatttttggtcaatatggaggttgggatgcgttcaggctttgtgatgaaactcacagaatttgcggtgagtggcgcgatccgcatggttcatcaattccaatcagccttaaggatatatttattgctcttggaaagttgccagaagcagcaacagtaatggcgaatagcattaatgcgcaaaataatcttgatatattattaggtgatctgaggtagtcgggatgatgttcagcccttatttgtatttaccggggagggaagatgtttaattccgattccccggctccacaggcctaacctaactttatgtaacagtccatgcagggctgaaatctgcctgctgaaataactccgttagcccgctaatctgctttaacctcagaacttcatcctggtccatccccagttctgttccgatacgttcatcagtccagccaagacgtgaaagatctctgacaatatcagacattgaggttatctggtgtttccccctggctctgttatgtcggatagtcgcggcaatacgtgaggtttgtccctttcggtctggattaatacaggttactggtagccagcctttcaggcgttttccagtaactgttcttctacctagtaactgcctatgaaaaccatccaccaccaggtaatggcttgtttcttccgaaacaacaattggttgagtaaaaccgtctttttccagagattgtttcagtaattttttttcgcttggggccatgacattgggattataatcgttagcgacaatttcatccgcttttacccacagcacacagtccactggttcttgagcaaaggggctgatctcatggagtacgcagcggagatggttcagggcctgtatggttttctcttcagattgttcctgactgaagtactgtcgaatcatcttgctcagcacctccacctctggtgtcacagaattccccattccttcctcctttcattcatacgctgcaggtaacgttcatagtgccggggtttgttggggctgaaggagagcgttcggcaccagaaatcattctttatgagagtcttacaaatacgtcgccaagagggaacatcccggcagcccagatcattttcctgttcatccgggatatcatccgggaatccccggttctgataccagcgcaggtagactgctatcttgttgcggtagtgttcagccgttctttccggcattacgtccagcaggaagaacgcatagctgcgccaggtatgatgggatggttttgacatccgtttacgcagggcaaaataggccccgctttcattggcataaagagccccactggcagcaccagatactcgttcacacatccgtgcccaagtttctggctccagaacatgataaagccatagtcccttacgctgttccgggccaaaaggctcacagacacgcatattacgtagaggaatgcctgcacggtacatcaaatcatacagaggattgtagattgcacaggttttagcgttatatacccagatatcgttggttttccagtcatacagcggatacatggtgtagtaaaaaccttcaggtgacgccgtggtccagggtttatcatctgcatatctcagttttcgttgggaaaccagtcccataaatctgttaagagattcatccgcgcggactccagtcagtattgccacgctacattggttacttgcgaaccaggaagaaaaagctgggacaaattcttcaaaagtcatggcgtagcggtaaaaggggaaatacgccatatcagtaatagcatcttccggtggctgtcgaacccactctacaccgggctcccagcatatccactcaggctgaaactgcgagacaccatttactgtcgtcaggggaagtgcaacccagtaaaaggtatctgttacatcttggtacatcatccgcatcttctgtatatgatcaatggtgcattgatactgggcttcccagtcaatgaacaatacagaaaaacgacgtttcttcctgtaggccacttcggctacaagatggaaaagtacagtggaatctttaccgccagaaaaagataaacatacagaagagaatgtttcaaacaaccattcaatgcggtgaatggctgctgacaaaacatcttctccagttctgatttttgttatagttaccggcatacaatctgataaaaatagcgagggtttgcattttacctagtaacgttatgtaactatttttttgaataaaggcaatgagataatgataaaaaatgtttatctaatgtactgagctcttctctttattgtattaactcttcgatttcagcggcgttgtcgttcaggcatgaaaaaaggagccgaagctcctttggtttcagaattcaaattgtcttgcccgcaggcttttcagcattggcatggcccgctggataacggaacttgacatgtcgagacgtgttacctcccttagtagcgcgtctctgttcttcgtcaccatgtagatagtctcaaacgcaatgtcatacagcttgttcgtgtatgaggagttcagctctttcattatggggtacagctgcttgctaaggtcctgggctttttccatccagagttgcatgtagcaaaggaggatgatttcctcggcggtaaattgtggctgtgattctgcttgtactggctgaatgttgcgaagtttcttttcgcactcgatgaagtagcggcggatctggcggcctttttcgtttcgttcaaccatcgcaagctctttggctgtgtccagggtgaggtggtagtccttgcggcggcggcctagagttttcgccaaatttggcgaaaatagaatgtagtctaaattttctacgaatccatactcgtttagcctggcccgtatccagttagaaaaatctttacctacctctaaaaacccatgcaaatcacgcgcgttcaccagaagcgtaggttcatttgagattgtaccttcaaacacagggatgagttgagtggtcatgatgacctcctttggcttttttcgagaaatgccaccacaaaatgtggtgccgggaggctcgaaacggcccaaaagataccgcggacttattccccttgcgggtgttgtattcgtcgccctcccgacatggatcggggatgtgaccgcacattgtgccatcactgaatgacaggcataaaaaatccaacactgacggggttggcttaatccgcttttgggaggttttcgaggtctcggcgcggagtatagtcactattggatgctgtcgtcaacagcgtggttacaattcattccaaatgcgatagttttttatttgccatattaagctattggagaccctgtatttatctgcaagaactgaatttggtacactcatttcattagctcttataaatagcacttgctctttagttagttttgctcgcccatgtttttcatgacgtgcttggcgttttcgtttctgtcgatcagcattattatcaaggattgttcctattagtaaatgctttggattacaacatgcaggattatcgcaagaatgcctgacaaccatgcccgcaggaatttctccaataaaaattcggtaaattaacctatgcgcgccagttttaatacgtttaccctttgagccgattaaaagacgcccataaccaaaatcatcttttggtaaaatattttcaatgcaattgtcaggaaaattatttaaaaggtttttcatgagaagcccgatataaataaaaaagccgcaaagctatcgggtgcggatgaccgcttatttgttcagtgcggtcagtatgcgatagctcaggcggatttgtcaatctgcggaaatattgatgaacgagtgacggtatatacccaacccggacaattaacgtaaattcacatcgtaaacttgcgttaattgtctgaaatatctacttaaaccctattaaatttttggggcactattggggcaaaatgtggttgtttggggcatatttggggcaaaaaagaacgtataaataacggtgtaaaatcgatttcttcatggtcaaaatgaggtgtaacagattgaaaaatatgtgctcttggacgatcttcggtaattctgtgtttttaatgcatcatggtttcaatatgtccgtacatggaataataaagcaccagaactttagccatttctaaccactcctcgtgttatctctattccgtagcgattcgctaccacttatttaaagataagacgtccttttcagagtgcaaatttcacaaccacttatttgatttataacaactttcacaagcacgtaattttgtcgcaaaatgacacatttttatctcatcgcgtttttttaatcataagagcggcttatggataattattggagatgatatctattctcgctaagaagctgttgcaggatattaccaaacgcgggtctgcccgcgtcagttcactaagcttagtcccacgtagcgaaaatatggcagccgccatacgccgcgttaattctatgcaatatgatgtctatacccagacggaggtcagtaatggcaaaccatcgaggcggttccggcaattttgcagaagaccgcgaaagagcatcagaagcaggtaaaaaaggtggacagcacagcgggggtaatttcaaaaatgacccgcagcgcgcatctgaagcaggtaaaaaaggtggcaagagcagtcacggtaaaagcgacaactagccgggctaatcaatgacacatgcatttttgtctgtagctcgtcaaaacgccatcaccgccggttaccccggcggttttctgtttatggctcctgatgaacaacttctggcggtggaacgtcaaccaaccttctgcttaacaacgcattgagtaaaatcgcgccaaaggtggctgtaccgatccctcccaacgtaaaaccgcccagtgtgagagcaaaatcatccgcacccagcactaaggttactgcgaccataatcaaattaccgttctggcttaaatccacactgttttgtacccagatccgtgcgcctgcgacggcaatcagcccgaacacaacaattgatgcaccaccaatcaccgcagccggaatagtatggatcagcgcgccaaatttcggcgaaaagcccaacagcatggcgatgacggcagcggcaacaaacaccagcgtcgagtagacttttgtcacggccatcacaccgatattctcggcgtaggtggttacgccgctaccgccgacagagccagaaagcatcgtcgccagcccatcgcctacgaatgcccgccccatatacgggtccatattgcgtccggtcatcccggcgaccgccttgagatgacctaagttttccgccaccagaatcaccgccacgggcgcaatcagcatcattgcctgaccattaaaagcaggagtggaaaaatgtggcagaccgaaccaggcagcatggctgacgagagtaaaatcgacggcttttcccagccctaaaacgttggtcatcacgccatacagcagacaggcgacaattaatcctacgagaatcaataatcgctggatcatgccacgggtaaatacggccaccagcccaatacatagcaccgtcattaccgccatccagctatcaaaggccgaagccgatacatttttcactgcgataggcgctaagttcaggccaatcgccatcactaccgcacccgtcacaaccggcggcattagtcgttcaatccagcgcgtaccgattttcatcaccaccaggccaatgacggtataaaccagcccacaggcgataatcccgcccagcgcgatgctgatattcggattaattccctgaccattaaagcccgtcgcggcaatcaccacgccgacaaaagccgcgctggaaccgagataactgggcacgcgcccgccggtaataaagaaaaacagtaacgtgccgatccccgacattaaaatggaaagattgggatccagccccatcagaatcggcattaacaccgtcgcgccaaacatcgccaccgcgtgttgaacgcccattactgccgtttgagcaaacggcaatcgttcatccggcgcgaccacgccgctctctgtagaggtcgattttaactgccagtgaggaaaaccgaacattgccatcagctgtctccttaaggaggttaacaagcagggcgcatcagcgcgtgataactgcgatcgaaccacaccagcccgtagggtgtggcgtgacgatgaatcgcttcgatggcgcaaaacaaaatgtcgtgggtgccgacgctcaccacctggctgatacggcagtcaaacgaaaccagtgcctcttccagttgcgggcatccggtcacaccagtctgccagcgggcggcggcaaagcggtgttccatgggcgttttgccgccaaaaaggtttgaaagcggctcctgcccggcgctaagtgtatttacacacagcgttcgattttcattgaataccggccagacggacgccccacgattcaggcacaccagtaatgtgggcggcgtgtcggtcacgctgcagacggcgctggcggtgaacccggcgcgcccggctggaccgtccgtagtgatgatattgaccgccgcgcccatacaggacatcgcatcgcgaaaggtttgttgatcgacaatgttcattgtttgctccttacaacagcccgcaggcttcttcaaaggacagacgtggcaggcgcgcaaaaagtttgctggaatcgccatagccgatattaatcagcagattgctcttcagcgtgctgcccgcaaaaaaggcgtcgtcaacgtattgacggtcaaagcccgacatcgggccggtatccagccccagcgcacggcaggcgacgatcagataggccgcctgcatggaactgttgcgaaacgctgtttcttcggcaagttgtgggctggaggtaaaccaactgcgggcatcgccgtgaggaaacagctgtggtaaccgttcataaaattcactgtcccaggcgacgatagcggtgacgggcgcggtcagggttttttgcagattgccgctggaaagcgccgggcgcagacgttcttttccttctgcagtgcggataaacacgatccgtgccggagaacagttagctgatgtcggcccccatttcatctgggcataaatctcccgtaacgtctcatcgctgacggggggctcccgccagccgttgtgagtgcgggcatcggtgaacagggtgctaagcgcacctgggctaacggcttcgttcatagcaattccttacagagcggcttcacggtgatgtaacaggctggcaagcccgttgagtaacagagcattaaacgtttcgggagcggtcacgttgcaggcgtgtccgccatagcgcatcaccattttctggctatcgggcagagcggcatgaagttcactggaacatgctgatggcaccagcagatcatcactggcgcagatgatttgcaccgggcagcggatacgatccgcatggcgactaaagtcagcgcgtttgagggcgttaagtcgacgcagtaaattatttttgccctgaaaatgcgccagtgccagcgcgtcttctgcctcaaggcgaggtgcgcgggccgccatccagtcggcgggatagaggaacaacggctgcgcttccacccatgcctgcgcgccgccgctatgtagtaactgttcgcgaacctgaaaacagcggcgcgtatgggcgtttattcgtagccagccgttaacgctgaccagcacagttaccgacgcgggataatccagcgccagctgcattcccaccagcgcaccgagcgcatggccgatcaccgcgtaacgctcaatccctgcggctaccagcgcctgatgcagttccgctgccatctgggcgatactgtaatcttctgccagcgtgtcgggattattgccggtgccgcgctggtcgtaacagactacctgatactcctgatccagcaccgccagttgcggtaaccagtaactgccgctaccgccaagacccgaaatcaacaccactacgggcgcatcagcataagggggaggtgagagtgaaagtttcatcgcggcctcacttggcgatatgcgcaattgtggcgatttccaccagcgcgtcaggttttaccagtccgcactgaatgcagaatcgcgccggtttgtcacccgggaaaaactcggcgtagatttcgttaatcgcggcgtaatttttccagtcggtaataaagatgctgttgaaggtcacatccgccatcgtgccacccgccgtctcgatgaccttgcggatggtttccagaacgtggcgggtttgcgcctttgggtcatcggcaaacagcacgttgttatgttgatcaaaagccagcgtaccggagacatacaccacgccatcagccagcgtgccgggaacgaagggggccagcggtgcgctgctgccagcaggaataattacggattttggcatcgttaaactccttaagcgatacgagcaaaggacgtggaagaaagcgcgtcgcagaacgtttcgacgtcgctgacccagccaaaaaaggtttcgatattgaacaacgcggctttctgtgcaaattccggccccgcctggtgtgttgcgtcttccagcaccacgccgaaatactccagaaaaaagccgtcgcgtagcgtcgattcgacgcagacgttggtagcgataccggtgaaaaccagatggcgtattccacggctgcgcaaaatgctgtccagcggcgtattgaagaaaccgctgtagcgcggcttcggcagcacaatatcgccaggctgcggcaccagttcatccaccagttgataatcccaggagcctttcgccagcaatttcccctgcagctgcggctgcttacgcatggttttcagggcgttcgatttatgaaaattcggtgagccggggccgccagcctcgacatactgttcatcccagccattttgaaaccagatgatcaacatccctgccgctcgcgctgcggtcacggcggtttgaatgttggcaatgaccgggcgagtggttgagacatcaaacccggcgagatctaagtagccgcctggcgtggcataagcgttttgcatatccaccacgatcagcgcagtttgctgcggatcgaaggtaatggcttccggtcgtgcggttaaggtcgtcatcatgccacctcctgagtcagcgcagggagatgggcgcggcactgcatcagtggttgaatgcgctcgccgaagttttcgattcccgacagaaaatcatcgaaggtcaacagcacgccttcggcaccaggcacgcttgcgacttcatctaacatgcgcgcgacactggcgtaagaaccgactaacgtccccatattgatgtttaccgccgaagtgggatcggccatctgacggacgttggtgtcagtatcggagcgggtatctttctgactttgttcggttagccagcttaacgcctcttcatccgcgcccgctttgtagtgttcccattttgcacgagcggcatcgtcggtttcgtcggcaatcaccataaacaacacataagagccaacgtcgcgtccggtttgctctgcggcctgtttcatccgcgcagcggtcggggcgaaagccgtgggtgtatttacgcctttgccgaaacagaagttaaaatcggcataccgggcggagaacgccatgccagcgtcgctttgcccggcgcagatcactttcatggggacactcggttgcggactgacgcgacaatcatccatagtgaaaaaatcgcctttaaaatcgcttttccccgagccccacaggtcgcgcagcacctgaacatattcggtgagatagtcgtaacgacgggagaaatagtcatcgccaggccagatccccatctgctcatactcgggcttctgccagccagtcacgaggttgacgccaaaacgcccgccagagatggagtcgatggttgcggccatacgggcgacgattgccggaggtaacgttaaggtggcagctgtcgcgtatatctgaatgcgtgaggtgacggctgccagccccgccatcaaggtgaacgactcaaggttgtgatcccagaactcagttttgccgccaaagccacgcagtttgatcatcgacagggcgaaatcgaaatggtagtgctccgctttttgcacaatggctttattcagttcaaaggtcggcatgtactgcggcgcgtgggtcgaaatgagccagccgttgttgccaataggtacgaatacgccaattttcatcatcaacctctcttcgtctcgtaaagtgaaagtcagacggggcgctgcatcctgcatatccttttcagccgcgtaatggcttgtttgcaaagcggatgccagtttttaaaaagtgaatgttatcaatatgttaagttgtctaaaatgcctgaaaaaagtggactaaacggtcaaaacagttgcacataaaacatgcattcgtgcgcgatgagagtgcagaaggtcgaggccgggcgggggttttgctatcctgttgccaatcaacaagaggggagagcgcatgacgcaaggcgcagtgaaaacaacgggtaagcgttcgcgcgcagtaagcgcgaagaaaaaagcgattcttagcgcagcactggacactttttcacaattcggttttcacggcacaaggctggagcagatcgcggagttggcgggtgtttcaaaaaccaatctgctgtattactttccgtcaaaagaggcgctgtatatagccgtactgcggcagattctcgatatctggctggcaccgttaaaagcgtttcgagaagatttcgccccgctggcggcgatcaaagaatacatccgtctgaagctggaagtttcccgcgattatccgcaggcttcgcgcctgttctgtatggagatgctggcaggtgcaccgctgttaatggatgaactgacgggcgatttgaaggcattaattgatgagaaatcggcgctcattgccggttgggttaaaagcggcaaactcgcgccgattgacccgcagcatttgatttttatgatttgggcttccactcaacattacgccgattttgcccctcaggtggaggcggtgacaggcgcgacgttgcgcgatgaggtgtttttcaatcaaacggttgaaaacgtgcagcggattattattgaggggattcgaccacgttaaagatgccggaggaggttgtaacatcctccggctacctgtttaaccgatcgtcattaaactggcgttaccgccagcagcagcggtattcacactcagcgaacgctcgatatacagccgttccagaaggatattgctttcgccacgggcaaaaccctgcaccgaaacaattgcaccatcccgcgcggcaacggcttcacacaatgcgcgaagctgatccgaatcaccgtggaagatcaccgcatcaaatggttgagcggttatattttccgctttcgccagttgaatacgttcgctgactgccgatggcaatgccttcactaactgacgatgcagcgcatcatccggccacagcacctggctacccaccgccagcacggcggcgagctgagtcagcgcatcctgttcatcatccgcaatacacaacacgcgctcacgcggcagcagcgtccaggtgttgcgttcacccgtcggccctggcaacaatcgttgtgttcctgcctgcgccaactcgccatattgcgtacataacgcctgcaattctggacggtttgccgcccattcccgcagtgcatttagcggctgagtcaatgcggctttcaactgcgcatcgaccggatactccgcatcctgacgcgcgagcgtcaccgccagcgcactttccgggcgattcgccagcagacggtagagatagagcggaccgcctgctttcggcccggtaccggacaacccttcgccgccgaacggttgcaccccaaccaccgcgcccaccatattacggttaacgtacagattaccgacctgggccgagccagtgacctgggcaatggtttcatcaatacgcgtatggacgccaagcgtcagaccataaccggaagcgttaatctgctcgatcagcgccggcagctggttacggttgtaacgcaccacatgcagcaccggaccaaagacctctttttgtaattcggcaaagtcatccagttcgatcagcgtcggagcgacaaaggtgccgctttgccattcacgggcatcttcactgttttcccgcactgcctggaacaccgggcggcctttgctacgcatagtctgaatatggcgctcaatattggtcttcgcttcgccatcaatcaccggaccgatatcggtggtcaggcgacccggattacccatccggcattcggccattgcgccgcgcagcatttttaacgtgtggtcggcaatttcatcttgcaggcacagcacgcgcagtgccgaacaacgctgacctgcactgtcgaacgccgaggccagcacatctattacgacttgttcggtcagtgctgaagaatcgacaatcatcgcgttcatgccgccggtttccgcaatgagcggaattgggcgaccctgagcgtccaggcggctggcgatattgcgttgcagtaacgtagcgacttcggttgaaccggtaaacatcaccccgcgcacgcgttcatcacccgtcagttgcgcgcccacggtttcaccccgacctggcagcaattgcaccacgcctggcggtacacccgcttccagcaaaatggcgatcccttgcgcggcaatcagcggcgtttgttctgccggttttgccagcacgctgttacctgccgccagtgcggcagcgatctgcccagtgaaaatagccagcgggaagttccacggactgatacataccacaggccctaatggacggtgggtttcgttagcgaaatcatcccgcacctgtccggcatagtagtggagaaaatcgaccgcttcgcgcacttcggcaatggcgttactgaaggtttttccggcttcacgcaccagaataccaatcagttgctgcatctggctttccattagcacggcagcgcgatgcaaaatcgccgcgcgttcagccggaggagtggcaaaccagattggcgcgttattaaccgcactttccagcgcctgttctacttcacgcggcgtggcttcacgcacatagcccacaatatctttcggttccgcagggttaataacgggcgacatctcaccagccgcgaccgattgttccagcattggcaaggcctgccatttttgcagtgcactattgagcagggcagaggagagcgaggccagacggtgttcgttagcgagatccagccctgccgagttgtcgcgcccgtgaccgtaaagatcgcgcggcaggggaattttcggatgcggtaatccagtttgcccttcctgttgcgccagtttttctacagcagtgactggatcggcgaccagttcatccagtggcaaagaggtgtcggcaatacggttaacaaacgaggtgttagcaccgttttccagcaggcggcgcaccagatatgccagcagcgtttcatgtgtaccgaccggagcataaatacgacacggacggttaagtttgccgtcggcaactttcccggtgacctgctcatacagtggctcgcccataccatgcaggcactggaactcgtactgacccgggtagtagttttgacccgccagttgataaattgccgccagcgtatgggcgttgtgcgtcgcgaactgcgggtagattagatttggcaccgccagcagctttttcgcacaggcaagataagaaacgtcggtatacaccttgcgggtataaaccggataaccttcaaggccgtccatctgtgcacgcttgatttcactatcccagtacgcgccttttaccaggcgaatcatcagacggcgacggctgcgggtggcgagatcaatcaggtaatcgatcaccaacgggcagcgtttttgataagcctgaataacaaaaccgatgccgttccagcctgccagttcaggctcgaaacagagtttttccagcagatcgagggagatctccaggcgatcggcctcttcggcatcgatgttaataccaatatcgtactgacgcgccagcagggtgagtgatttcagacgcgggtaaagctcttccattacccggtcatactgggcgcggctataacgcggatgtagcgccgacagcttgattgaaatgcccggaccttcatagatgccacgaccgttagacgctttaccaatggcgtgaatcgcctgctgataggaaaccatatacgcttgtgcatctgcggcagtcagtgcggcttcgcccagcatatcgtaagagtaacggaaacctttctcttccagtttgcgggcattggctaacgcttccgcgatggtttcgcccgtgacgaactgctcgcccatcaggcgcatcgccatatccacacctttgcggatcagcggttcaccgctcttaccgataatgcggttcagcgagcgggagaggctggcttcgttatgggtggaaaccagtttgccggtaaacagcagcccccaggtagcggcattaacaaacagggacgggctacgaccaatgtgtgactgccagttaccgttactgattttgtcgcgaattaacgcgtcacgggtggctttgtcgggaatacgcaacaacgcttccgccagacacatcagcgccacaccttcctgcgatgacaacgaaaactcctgcaataacccctgaaccatacctgcgcgaccactggcgtttttttgattacgcagtttatcggccagttgatacgccagtttgtgcgcctgttcagcaactggctgcggcaggcgagcttgttccagcagcatagaaaccgcttcggtttccgggcggcgataggccgcggtgatcgcggcgcgggaaaccgactggggcaatatttgctcggcaaagtcgaggaaaggctggtgtggttcctctgccggagtcggtgcttcatcgctctcattggccgcgccagaaagcagcgcaggtagctccgggagagtatcgctgttttccagttgttcaagataagaaaaaatcgcctgtttaattaaccagtgtggtgtgcgatcgatacgtgtcgcggcagacttaatacgctcacgcgtcgcgtcgtccagcttaacccccatggtggtggttcccatgccattactcctgttgttctgaaaggtgcaacttaacgttatcgtgaaatatctatgatgttgcaactttgtgcaaccgtgttaaatgtgacctgcgtagcaagcttaaaaatgaatgaaatgttaataaacgaaatcgatatgacagggattaaaaaaataactcagactttttctctgcggcagttaacctttttgaaaggtgcaaccgcaaaaaatgtgagagagtgcaacctgatgaaaaatagtgtcgctgagcactaaaatttaatgtaaatggtgtgttaaatcgattgtgaataaccagcgcttccggcaggatacggtcgccctggtaaaacataaactctgttaccccgttccggtggcagatataacggcaagtttcgacattgccgataataattttttggagactttagatggctattagcacaccgatgttggtgacattttgtgtctatatctttggcatgatattgattgggtttatcgcctggcgatcaacgaaaaacttcgacgactatattctgggcggtcgtagtcttgggccattcgtgacggcattatcggcgggtgcgtcggatatgagcggctggctgttaatggggttgccgggcgcggtttttctttccgggatttccgaaagctggatcgccattggcctgacattaggcgcgtggatcaactggaagctggtggccgggcggttgcgtgtgcataccgaatacaacaataacgccttaacattgccggattatttcaccgggcgctttgaagataaaagccgcattttgcgcattatctccgcgctggttattttgctgttcttcaccatttattgcgcttcaggcattgtggcaggcgcgcgtctgtttgaaagtacctttggcatgagctacgaaacggctctgtgggcgggggctgcggcgacgatcctttacacctttattggcggtttcctcgcggtgagctggactgacactgtacaggccagtctgatgatttttgccctgatcctgacgccagttatcgtcattatcagtgtcggtggctttggtgactcgctggaagtaatcaaacaaaagagcattgaaaacgtggatatgctcaaagggttgaattttgtcgccattatctcgctgatgggttgggggctgggttacttcgggcagccgcacatcctggcgcgttttatggcggcagattctcaccacagcattgtccatgcgcgtcgtattagtatgacctggatgatcctctgcctggcaggggcggtggctgtcggcttctttggtatcgcttactttaacgagcacccggcggtagcaggtgcggtaaaccagaacgccgagcgcgtgtttattgaactggcacaaattctgtttaacccgtggattgccgggattttgctgtcggcgattctggcggcggtaatgtcaacgttaagttgccagctgctggtatgttccagtgcgattaccgaagatttatacaaagcgtttctgcgtaaacaggccagccagaaagagctggtgtgggtagggcgagtgatggtgctggtggtggcgctggtggcgattgcgctggcggcaaacccggaaaaccgcgtgctgggcttagtgagctacgcgtgggcaggctttggcgcagcgtttggtccggtggtgctgttctcggtgatgtggtcacgcatgacgcgcaacagtgcgctggcggggatgatcatcggtgcgctgacggttatcgtctggaaacagttcggctggctgggtctgtacgaaattattccgggctttatcttcggcagtatcgggattgtagtgtttagtttgctgggtaaagcgccgtcagcggcgatgcaaaaacgctttgccgaggccgatgcgcactatcattcggctccgccgtcacggttgcaggaagggtaagggaaggcgttttaccggaaatttcacgtcataaccggaagcaggcagagggcaatcagtgattgccctctgcgttttttctcaaaatatttttacatcttctcatcattatcactacattccacttgtatttttcttcatcgtaatgataatcgctatcactgcgatttacttttctttgcatagattgactcagaaaaacgtttaagggtgggtggcatgtttgttccgtttctcattatgttgcgcgaaggacttgaagccgcgctgattgtcagtttgattgccagctatcttaagcgtacccagcgaggccgatggattggtgtaatgtggattggcgtgttgcttgccgctgcgttgtgcctgggcttgggtatcttcattaacgaaaccaccggcgaatttccgcaaaaagaacaggaactgtttgaaggcattgtggcggtgatcgccgtagtgatccttacctggatggttttctggatgcgcaaagtgtcgcgcaacgtcaaagtacaactggagcaggcggtcgatagcgcattgcagcgtggaaatcatcatggctgggcgctggtgatgatggtcttttttgccgttgcaagggaagggctggagtcggtctttttcctgctggcggcatttcaacaagatgtcgggatctggccgccgctgggtgcaatgcttggtcttgctacagccgtggtgcttggcttcctgctctactggggcggtattcgcctcaatcttggtgcattttttaaatggaccagtctgtttattctcttcgtcgccgcagggctggcagctggtgccattcgcgcatttcatgaagccggattgtggaaccactttcaggaaatcgccttcgatatgagcgcggtgctctcaactcactcgctgtttggcacactgatggaagggatttttggctatcaggaagcaccgagcgtcagcgaagtcgccgtctggtttatttatctcatcccggcgctggtggcatttgttctgccaccacgcgcaggggcgactgcgtcccgctccgtgtagcaaatacgacgcaaactcttgcttagttacaacatactttaaagggatagtctcgtcatgaccattaacttccgccgtaacgcattgcagttgagcgtggctgcgctgttctcttctgcttttatggctaacgccgctgatattccgcaagtcaaagtgaccgtgacggataagcagtgcgagccgatgaccattacggttaacgccgggaaaacgcagttcattattcagaaccacagccagaaggcgctggagtgggagatcctcaaaggcgtgatggtggtggaagagcgggaaaatatcgcccctggttttagccagaaaatgacggcgaatttacagcctggcgaatacgatatgacctgcggtctgctgactaacccgaaagggaagttgatcgtcaaaggtgaagcaacggcggatgcggcgcaaagtgatgcgctgttaagtcttggtggtgcaattactgcatataaagcgtatgtcatggcggaaaccacgcaactggtgaccgacaccaaagcctttaccgacgctattaaagcaggcgatatcgaaaaagcgaaagcactgtatgcgccgacgcgccagcactatgagcgcatcgaaccgattgctgaactgttctccgatctggatggcagcattgacgcccgtgaagatgattacgagcaaaaatccgccgatccgaaattcaccggtttccaccgtctggaaaaagcattgtttggcgataacaccaccaaagggatggataagtatgctgaccagctttataccgatgtggtcgatttgcaaaaacgcatcagtgaactggctttccctccttcaaaagtggtcggcggtgcagccggactgattgaggaagtggcagccagcaaaatcagcggtgaagaagatcgctacagccacaccgatctgtgggatttccaggctaacgttgaaggctcgcagaaaattgtcgatctgctgcgtccacaactacaaaaagcgaatccggaactgttggcaaaagtcgatgccaacttcaaaaaggtcgataccattctggcgaaataccgtactaaagacggttttgaaaattacgacaaactgaccgatgctgaccggaatgcactgaaaggaccgattactgcgctggcggaagatctggcgcaacttcgcggtgtgctggggctggactaagcgttatgcagtatgaagatgaaaacggcgtgaatgaaccgtcacgccgacgtttactgaaagggattggtgcgctggcgctggcgggaagttgtccggtcgctcatgcacaaaaaacgcaaagtgcgccgggtacgctttcaccggatgcacgcaatgagaaacagccgttttatggtgagcatcaggctgggatcctgacaccacaacaggctgcaatgatgctggtggcgtttgatgtgcttgccagcgataaagccgatcttgaacggttgtttcgcttgttgactcagcgttttgcttttctgactcagggcggagcggcaccagaaacgccaaatccgcgcctgccaccactcgattccggcattcttggcggctacattgcgcccgataatctcaccatcacgttatcggtgggtcactcattgtttgatgagcgctttggccttgcgccacagatgccaaaaaagttgcagaagatgacgcgtttccctaacgactcgctggatgcggcgttatgtcatggtgatgtgttgctacaaatttgcgccaacacccaggacacggtgatccatgcgctgcgcgatatcatcaaacacacgccggatttgctcagcgtgcgctggaagcgggaagggtttatttccgaccacgcagcgcgtagtaaaggcaaagagacgccgataaatttgctgggctttaaagacggcaccgccaatcccgatagccagaatgcgaagttgatgcaaaaagtggtgtgggtgacggcagatcagcaggagcctgcgtggacaatcggtggcagctatcaggcagtacgcttgattcagtttcgagtggaattttgggacagaacgccgctgaaagagcagcagacgatatttggtcgtgataagcaaaccggtgcgccgctgggcatgctgcatgagcatgatgttcccgattacgctagcgatccggaagggaaggtgattgcgctggacagccatatccggctggcgaatccccgcacggcggagagcgagtccagcctgatgctgcgtcgtggctacagttattcgttgggcgtcaccaattccgggcaactcgatatggggctactgtttgtctgctaccaacacgatctggaaaagggcttcctgacagtacaaaaaaggttgaatggcgaggcgctggaggaatatgtcaaacctatcggtggcggctatttctttgcgctgccgggtgtgaaggacgcgaacgattatctcggaagcgcattattgcgggtttaatgtttttaggcggataaggcgtttacgccgcaccaggcgttcgtacactgatgcgacgcttgcgcgtcttatcatgcctacaatcggtgcgggtcggtaggccggataaggcgttcacgccgcatccggcaagcttttaccagtactgcgaatcctgctgaaagcacacagcttttttcatcactgtcatcactctgtcatctttccagtagaaactaatgtcactgaaatggtgttttatagttaaatataagtgaatatattgttgcaatgaatgcgaaatctgttgtacttattaagtagcagcggaagttcccggcagtgatagtcagtcactatggagatcgcggatggtaacgtcctgtactggacatgttttagataatcagcgcgccaccactcgcggagatttctcctccggtagtcatctcgtcactttgtattttcaacctcatcctttcttttcatgtgttaccgacgccgtaaacggtgcgcgtagccgtttttcggcattttatccaaaagcaaactatggcttacaaggaagccaaccctctgatgttcgtgcgcataatcgcgctgccaacggcgcgtgtgatgaatacaaacaactcaaggtgctctccatgggaagacaaaaagcagtgatcaaagctcgtcgcgaggcaaaacgtgtgctgagacgggattcgcgcagccataagcagcgtgaagaagaatcggtcacctcgcttgtgcagatgagcggcgtagaagccattggtatggcccgcgacagtcgcgatacctcgcccatcctcgcgcgaaatgaagcgcaattgcactatctgaaggctattgagagtaagcagctgatatttgccacgggcgaagccgggtgcggaaaaacctggatcagcgcagcaaaagcggcagaggccctgatacataaggatgtcgacaggattatcgttacccgtccagttctgcaagccgatgaagatcttggtttcttacctggtgatatcgcagaaaagtttgctccctattttcgcccggtctacgacgtgctggtccgtcgcttaggggcttcctttatgcagtactgcctgcgaccggaaatagggaaggtggaaattgcgccgttcgcctatatgcgtggacgtacctttgaaaatgcagtcgtcattcttgacgaggcgcagaatgtgactgccgcgcaaatgaaaatgtttttaacccgcctcggggagaacgtgacggttatcgtcaacggtgatatcacgcaatgcgatttgcctcgcggcgtgcgctccggattaagtgacgcgctggaacgtttcgaagaggatgaaatggtcgggatcgtccgattcggtaaagaggattgcgtacgttcggcactttgccaacgtacgctacatgcatacagttaagtgtattatcggtgcagagcccgggcgaaccgggctttgttttatttcattaacagcaaagattttcacttcaggttaacgttcagggggcgactttgagcgtgttgataagctgaaatgaattcaggtttagatactcttaccgggcatttgtcgtcatagcaccagaccagtgtaataccgccagtgcggagagtttttctttcagaagcccaaaaagcgagcatctgcctatcttttttcagccattcaacctgtacaggaggtctggtgccaattttgcgtatgaggttccatcaataatggaccataatttgactgactgattaacaccgaatacattcccctgattatattttttagggataacattaaaaatgtcaggttaatcttaattaattctttggctaatattttgtgttgttattttttgtggaaggcaagccgcaatggcaaaataggggtggttgtaataataaaaacatgatactaactatatattgatcgttgaattgttggcatgtaacacgctacagcgagtaacgttggtaatgaaatataatcaacatggataggtgaaaattaattatgagctttatggcttttgtaacttgtttgacaattgcatttgtcgccggttttgttgttgccagaaaattgacactccgaaaagttgcctcatcggtgatcatctctaaatcgcaaccagtcccttcatctgcaactccccctgctgctaaggcgtcgacaaggagctatacaccgcagaaaacctatcgtgattctcgttggcaagaacgagatgagttatttcagggaatggttgccgaaggcattttattggaaggaaaagagtggttaattacgcgttgtgagaaaatctatttcgataatctggataaatggtttggacattattgccatatccattgccaggtctctctggggcgcttgatcaactttccagaacaacctgagtttagcgaagaagaaagaaagcgtttctttgctatttataatggcatggcaatggattatgtgctggtttcaaagaagaacaataaaatagtcggtgttattgagctggatgatccgagtcatgaaagggcagatcgcattattcgtgaccattggttggatacgattatgactcttgctcgggtgccttttgtacgagcttctgtcactaaattggaggaaatccctccggtctgggatacccgtgacaaaattcgcccattagtcgcggcgacaaagagtgaaccgttgcattaaccaggtatccccggtcggggtttctcatccccccggtgtatgcaatatacgaaaaaaaagctcgtactttcgtacgagctcttctttaaatatggcggtgagggggggattcgaacccccgatacgttaccgtatacacactttccaggcgtgctccttcagccactcggacacctcaccaaattgtcgttcctgtcttgctggaacgggcgctaatttagggaaatcatgacctgaggtcaacaaactttttaaaaaaatcgctcgattattcaaacttcaatcaatatgcagttttaataagcgaaatttgctttttttgccaccgaccacggatttgttatgctggtggtctttgtagatcataacgataagtgcgaataaatttcgccaacactcttcgggagtcagcatggatatcatcttttatcacccaacgttcgatacccaatggtggattgaggcactgcacaaagctattcctcaggcaagagtcagagcatggaaaagcggagacaatgaatcagccgattatgctttagtctggcatcctcctgttgaaatgctggctgggcgcgatcttaaagcggtgtttgcacttggggcaggtgttgattctattttgagcaagctacaggctcaccctgaaatgctgaagccttctgttccactttttcgcctggaagataccggtatgggcgagcaaatgcaggaatatgctgtcagtcaggtgctgcattggtttcgacgttttgacgattaccgcatccagcaaaatagttcgcattggcaaccgctgcctgaatatcatcgggaagattttaccatcggcattttgggcgcaggcgtactgggcagtaaagttgcacagagtctgcaaacctggcgcttcccgctgcgttgctggagtcgaacccgtaaatcgtggcctggcttgcaaagttttgccggacgggaagaactttctgcatttctgagccaatgccgggtattgattaatttgttaccgaatacccctgaaaccgtcggcattattaatcaacaattactcgaaaaattaccggatggcgcgtatctcctcaacctggcgcgtggtgttcatgtcgtggaagatgacctgctcgcggcgctggatagcggcaaagttaaaggcgcaatgctggatgtttttaatcgtgaacccttaccgccggaaagtccgctctggcaacatccacgcgtgacgataacaccacatgtcgccgcgattacccgtcccgctgaagctgtggattacatttcgcgcaccattgcccagctcgaaaaaggggagagggtctgcgggcaagtcgaccgcgcacgcggctactaataaagcatcaggtttcctgctatccttggcgggaattgaatacaggagagagttatgtatcccgtcgaccttcatatgcataccgttgccagcacgcatgcatatagcacattgagtgattacattgcccaggccaaacaaaagggcattaaactttttgcgatcaccgatcatggcccggatatggaagatgcgccgcatcactggcacttcattaacatgcgtatctggccgcgagtggttgatggggtagggatcctgcgcggcatcgaagctaacattaaaaatgttgatggtgaaattgactgcagcggcaaaatgtttgattcgctggatctgattattgccggttttcatgagccggtttttgcgccacatgacaaagcgaccaatacaaaatcgatgatcgccactatcgccagcggcaatgttcatataataagtcatcccggaaatccacgatatccaattgattttaaagctgttgctgaagctgcagcgaaacatcaggtggcgctggaaatcaataattcctcatttttacactcacgtaagggcagtgaagacaactgtcgtgcggtagccgcagcggtacgtgacgctggaggttgggtggcattaggctcggattctcacactgcgtttaccatgggggaatttgaagagtgtcttaaaatcctcgacgcggtagattttccgccagagcgcattttgaatgtttctccgcgccgcttacttaacttccttgaatctcgcggtatggcaccgattgcggaatttgcagacctttaattactagtaatggaaatatattaatgaatgagttttctatcctctgtcgtgtgctgggttcgctctattaccgccaaccgcaagatcctttactggtgccgttgtttaccctgattcgtgaggggaaactggctgcgaactggccactggagcaggatgagttactgacgcgtttacagaaaagctgtgatatgacgcaagtctctgccgattacaatgcgttgtttatcggcgatgaatgtgctgtgccgccatatcgtagcgcatgggttgagggcgcaacggaagcggaagtgcgcgcttttctttccgaacgagggatgccactagcggatacgccagccgatcacatcggcacattgctgcttgcggcttcctggctggaagatcagtcaacggaagatgagagcgaagcactggaaacactgttcagtgagtatctgttaccctggtgtggtgcgttccttggcaaagtggaggcccatgcaactacgcctttctggcgcaccatggcaccgctaacccgcgatgctattagtgcaatgtgggacgagctggaagaagattctgaagagtaaatgtgatctgcatcactcataactgcaacgggtaatttgttgttgcataaaatgtgtgctcgatctcattcatggccgcgttttctgctatcatgcgcggcatgaacatacttctctctattgcaatcacaacaggcattctctccggtatctggggatgggtggctgtttccctgggcttactaagctgggcgggcttcctgggctgtacggcctactttgcctgcccgcaaggtgggctgaaagggctggcgatctccgctgcaaccctgcttagtggcgtggtgtgggcgatggtcattatttacggtagtgcattggcaccacatctggaaatactcggttatgtcataaccggtattgtcgcgtttctgatgtgtatccaggccaaacagctgctgctttcatttgttccggggacgtttataggcgcatgcgcgacgtttgccgggcagggtgactggaaactggtgttaccttcgctggcgcttggactggtatttggttacgcaatgaaaaacagcggcctgtggttggcggcgcgtagtgcaaagacggcgcaccgtgagcaggaaatcaaaaataaagcgtgaggggcactcacgctttcgcttaaaccgtaaaatgccggatgataattccggcttttttatctgtcaggattccggtggaaccgacatatggcggtatttcaccagaatgtcgttctgccgttctgctttgttctgcaaatcccacagaccacggtcaataccatcattaatcaggaaaatgacccctgtttcgatagccgacatcaggcacagcataacgggttcgttcgaggtgtaacccacttccccttccagcaagcgctggtagtcaataaagcggaaaaccccggcctgaacttcataagaaagtatcgtcttactggtgttcaccgaggagaggatctcaccggtactcacattgacgacgcgcaggttcacggcaatctgatcgagctggtattgcgtgtcggcaccgatcccaaaatatcttgccccaaccccgcccgatttgacgttgctttcataaccgataatcgaaccttcaaccatgatatttgccgccgttaaagattgcagcgggattcggttattaatggcaactgtgccgttttcttgtgccgcacgaataatcttgcgctcgttaagcagattttgtaagccctggcgctccagcggtataaaccagcgagaatctttcaatgccgtgaccagcattgccgtggcgctttgcggaacagcagtggagaagttacttgccgggtagggtttaaattgcccggtttcgtcctgaatgttgtataccgaaacaaagatcttacccgtcggcgctggcagatgggtcaaatctttgtagctctgagcacgaggcattaatgtcggtctggcggcttctttaggcggggcggttaagcatccgctcagtaacatgacggcaaccaaaagaaataagcgctgcatgattattttccttatgaagctggggcttaaaaatcggttgagttattttgtaaacccgaaacctggatggtcgaggtttgtccggttttacgatctgtcacgttcaactgcaattgaccatcgcggttagcaatatcaacaatataatcgttggtcaccatgcggcccggtttaccggtattaatattcgacagtagcccacctaaaatttgtgactggatggcctgagtaaagttatctaacgctgatggcgtttcaataccaaagtcatcgttatagctcggatctttataagagttttgtgcctgggcgctatttaataaaaaagcaccgttatttggattaccaccaaagtttggattacggaactggaaagtcatggttccagcccaacttaatggcgaaataagcatgagtagaactactgcatgtttgacacgcattgcagcctccgaacaattttttatttaaaattcatcatgcgccaaatcgcccgtacttaataacgcctggtttatctggcgacgatttagtgcttcttcagtttgaatcagtgcaaagacgacagttttctcgaagtctcttttcaacggaaataaaaaagtctggaaaataacgtcctgattcaccgttattgtgatccagcttccccatcgtgcactgggcctttcattaatcgttaagttacccgtatagtcactttcccatttatcactaaaggctcggtaaaaatcatggccaatagatgaaacagtatggtcagttaacaatcccgggacttctacctcaacggcgtgaagattccctgcggcgaacagaaattctgccgccacaatccagcgtaaataacgtttcatggctttatcgcctgaggttatcgtttgcccaggaaaccgcttgtgtccggttttttacggctatcttcttgaaaagattataaagatgcgttttaaccgtattttcgctgatgaacaacgaacgagcgatctcgttattagacgcgccgatacgcagcttattcaggatctctttttcccgatgagtaaggagggctgattccgtgctgttataacgatagttacctgaatgcgtaatcaggtaactggcaagcttttgcgtaaagtagcattcgccgcgcaggacgccttgcaacccattgacaacacgttcttgatcctccatggcataaaaaacgccgttgatatgaggccagttttcaatgtcgcggtacgggtaatcttcaggcgtatttagcaacaatattttgatattgttgtttttcctgctcaaagtatcctgccaataatggataagctttttatccgcttccatcatatccagaagaataatagagcctgaagatatatcgtccagagaacgttgaatattatgtaattttcctgtaattgccagcgattgtttaaggtgctgcaagagagctgtcgcctgcaaagaaggtttagtgatcaacaataatgtatgaccatgaatactatggacttcattaaacatgatgaaaccccgctttttttattgatcgcacacctgacagctgcctctaaaatagaagcaccagaagtactgacagatgttgcactgctgtgtgtagtaataaatcagccctaaatgggtaaaatataaaactaatggattacatctgatttcaatctagccattacaaatcttaaatcaagtgttaaacatgtaactcgttatattaaaatgttaaccttaaggttttattaagtttataaatgatagaaaagttgtacatttggtttttattgcacaattttaaaaaatcatacaaatggtgctaacttactaataatgcatataaaaaatatttcgctgtagtcctttcgtcatgaaaaacgttcttgttttttctccataccaccgtggacaattttttactgcaaaaagacgaggtttgtcacggcttgtgcgcaagacatatcgcagcaatcagcgacgggcaagaagaatgactgtctggtgatttttgatagcggaaaacggagatttaaaagaaaacaaaatatttttgcgtagataacagcgtatttacgtgggttttaatactttggtatgaacaaaaaaagaaaaatacaacgcgcgggtgagttattaaaaatatttccgcagacatactttccatcgtaacgcagcgttaacaaaatacaggttgcgttaacaaccaagttgaaatgatttaatttcttaaatgtacgaccaggtccagggtgacaacatgaaaaacaaattgttatttatgatgttaacaatactgggtgcgcctgggattgcagccgcagcaggttatgatttagctaattcagaatataactttgcggtaaatgaattgagtaagtcttcatttaatcaggcagccataattggtcaagctgggactaataatagtgctcagttacggcagggaggctcaaaacttttggcggttgttgcgcaagaaggtagtagcaaccgggcaaagattgatcagacaggagattataaccttgcatatattgatcaggcgggcagtgccaacgatgccagtatttcgcaaggtgcttatggtaatactgcgatgattatccagaaaggttctggtaataaagcaaatattacacagtatggtactcaaaaaacggcaattgtagtgcagagacagtcgcaaatggctattcgcgtgacacaacgttaatttccattcgacttttaaatcaatccgatgggggttttacatgaaacttttaaaagtagcagcaattgcagcaatcgtattctctggtagcgctctggcaggtgttgttcctcagtacggcggcggcggtggcaaccacggtggtggcggtaataacagcggcccgaattcagagctgaatatttaccagtacggtggcggtaactctgctcttgctctgcaagctgacgcccgtaactctgatctgaccattacccagcacggcggcggtaatggcgcagatgtgggccaaggttctgatgacagctcaatcgatctgactcagcgtggtttcggcaacagcgctactcttgatcagtggaatggtaaagattctactatgactgttaaacagttcggtggcggtaacggtgctgctgttgaccagactgcatctaactccagcgttaacgtcactcaggttggctttggtaacaacgcgaccgctcatcagtactaatacatcatcagtatgaaagaaacagggcgcaagccctgttttttttcgggagaagaatatgaatgcgttattactccttgcggcactttccagtcagataacctttaatacgacccagcaaggggatatgtacaccattattcctgaagtcactcttactcaatcttgtctgtgcagagtacaaatattgtccctgcgcgaaggcagttcagggcaaagtcagacgaagcaagaaaagaccctttcattgcctgctaatcaactcattgctttgacgaagttgagtttaaatatttccccggacgatcgggtgaaaatagttgttactgtttctgatggacagtcacttcatttatcacaacaatggccgtcctcttcagaaaagtcttaatttgttgaaatatcgagcataagatgaacctggagagaatggtctgctgcgaatcagccaacctgaaagtatggataacacaaccctcaaggatgactaatcattgaggaaatagaataaatgttcagaccttttttaaactctcttatgctcggcagtttgttttttccttttattgccattgcaggaagcaccgcgcaagggggcgtgatccattttaatggccaaattgtggaaccggcatgtgacgtcagcacccagtcatcacccgtagaaatgaactgcccacagaatggttctgttccgcgtaaaacctattccagcaaagcgttaatgagcggcaatgttaaaaacgcgcaaatagcctcagtaaaagtgcagtatcttgataaacagaaaaagctggctgtaatgaacatcgaatataactaagtttctgaacaactcacgttgctgagcagaaaaatgcgatttaaccaaaaagcctgctgtacacttaggaaacaagaaggtgtaaggaggcgttatgaaaacgcgtattcatgttgtgcagggtgatattaccaaactggccgttgatgtgattgtgaatgcggctaatccgtcattaatgggaggcggcggcgtcgatggggccattcatcgcgcagcgggtccggccctgctggatgcctgtttaaaagtcaggcagcagcagggcgattgccctacggggcatgccgttattacgcttgcaggcgatcttcccgctaaagccgtagtgcacaccgtcgggccagtctggcgtggtggtgaacaaaacgaagaccagcttttgcaggatgcctatctcaatagcctacgactggtggcggcaaacagctatacgtcagtggcttttcctgcaatcagtactggggtttatggttacccccgtgcggcagcggctgaaatcgcagtaaaaaccgtttcagaatttattacccgtcacgctttacccgaacaggtatactttgtctgttatgatgaagaaaacgcccacctctacgaaagactccttacccaacaaggagatgaatgatttgcctcagctggcgagcgcggtgctgccactgtgttcgcaacatcccggtcagtgtggactttttcctctggagaaaagtctggatgcgtttgccgcccggtatcgtctggctgaaatggcagagcatacactggatgttcagtattacatctggcaggacgatatgtcgggtcggttactgttttccgccctgttagccgcagcaaagcgtggcgttcgcgtacgtttgttgctggacgacaacaatacgcccggacttgataacattttacgcttgcttgacagccatccacgcattgaagtccggctttttaatcctttctcgtttcgcttgctacgtccgcttggttatatcaccgacttttcccgtctcaatcgccgtatgcacaataaaagtttcactgtcgatggcgtggtgacgctggtgggaggacgaaatattggtgatgcctattttggtgcaggggaagagccacttttttcggatttagatgtcatggcaataggacccgtggtagaggacgttgccgatgatttcgcccgctattggtattgcaaatcggtttcccccttacagcaggtgctggatgtcccggaaggtgaaatggcggatcgcatcgagttaccggcatcctggcatgacgatgccatgacgcatcgttatttacgcaaaatggaatccagtccgtttataaatcatctggttgatggaacgttgtcgcttatctgggcgaaaacacgtttattaagtgatgatccggcgaaaggggagggcaaggcaaaacggcattcactgttaccgcagcgcctgttcgatatcatgggctcacccagtgaacgcatcgatattatctcttcctattttgtaccgacacgtgcaggtgtggcgcaactcttacggatggtgagaaaaggggtaaagattgcgatcctaaccaattctcttgccgctaacgatgttgctgtcgtccatgcaggatacgcgcgctggcgcaaaaaattgctccgctatggggtggaattatatgaactcaagccgacgcgtgaacaaagtagtacgttacacgatcgcggcataaccggtaattcaggggccagcctgcatgctaaaacctttagtatcgatggtaaaacggtgtttatcggctctttcaatttcgatccgcgttcaacattgctcaatactgaaatgggctttgtgatagagagcgaaacgctggcacagttaattgataaacgctttattcagagccagtatgatgcggcctggcagctccgtctggacaggtggggacggatcaactgggttgatcgtcatgcaaagaaagagattattctcaaaaaagaacccgccaccagtttctggaagcgggttatggtcaaactggcgtcgatattgcccgtggaatggttattgtaaacgcgacttaacgggctggtgctttatcgttctcacgcttaacaaccggtttaccagagaacaaaaacttcaataatgggatgcgtaaatgaatttcatacagaattatcgcaatccctactacgaatatcaggccacagagaaaaccaagccagttggaggtgatgtgtggtgtaatgtatgcgccgaaaaacagcgttaacgggtggtgaaccagatagataaacagcgatgcgttaacaaaataagtcacccgcgctgactggaagttaagcaaacggtggccaaaggagaagaccacattcaccatccacagaccgaggaccatagtgatcaccgactcggtttcatacatccaggcatcgccactgccatagcgctggttgagtaaataagcgacaaacgccaatgctgctgcaagggtactgccacgagacggcgtggtaaacaaggctttaagatgagggaaaatgaaagccagtgcgccgaggataaagaacggcaaataaaataacgtttgcatgacaataaaattgaacatgccgttactcagaatgggtggatacacaataaaaatcgttcttcttattaccgcataaccgatgccgaggcacaaaaaaatcaccgataattttaccatcgagaattttttattcgttttatcagaattttctaaattatttctgatgcgtttaaatatccatacgcacagcgtcgtcatgaccactaacaccagtaaaaaccacaggtgtgatattaattcccaggccaacgtattatatttgtcatacaatgacagcccaggccaactttccgctttccctttgacgtattgcagcataataaattgcggcaatgtcagtaaggggatggctgttaacatcgggatccctacacgttcgacacgtactttccaccattttttcaagggatagcgtaaaaaaagcatgtaggaaaagtacccggatataacgaaaaacacctgcatgcggaacgagtggatgaagtcattaaaaagggtcagccacaatgacggttcggcgctattcacatgccatgtatggctcgaatagattaaagaaatatgaaaagggatccctaacaacatcagccaggcgcggatggagtcgaggaaatattcacgttgcgcgggtactggattcatatatggttaactaatctcggatttttcgtcttatccctgtcgggttatgcctttaggcttgttgccatagcgacaccgacctgaccgcgccaggcgcaggcttcaaggtttttatgcatagcatcatcgctaccactaaccagaatggaagcgtctgtaagacggttgataaataaatttgctggcaaaccctacacgaagtcgatgcttctgtctttaggagaagctcggaaagtgaaaacggttgcaatcaggtgcttaatccatgagccagtgtgctgaacgataccgggattctgttgtcggaatggcaggttatccattaaaatagatcggatcgatataagcacacaaagggggaagtgcttactaattatgaaacataaactacaaatgatgaaaatgcgttggttgagtgctgcagtaatgttaaccctgtatacatcttcaagctgggctttcagtattgatgatgtcgcaaagcaagctcaatccttagccgggaaaggctatgaggcgcccaaaagcaacttgccctccgttttccgcgatatgaaatacgcggactatcagcagatccagtttaatcatgacaaagcgtactggaacaatctgaagaccccattcaaactcgagttctaccatcagggtatgtacttcgataccccggtcaaaataaatgaagtgactgccaccgcagtcaaacgaatcaaatacagcccggattatttcactttcggcgatgttcagcatgacaaagacacggtaaaagaccttggttttgccggtttcaaagtgctttacccgatcaacagcaaagataaaaacgatgaaatcgtcagcatgctcggggccagctatttccgcgtgattggtgcaggtcaggtttatggcctttctgcacgcggcctggcaattgataccgccttgccatcgggtgaagaatttccacgcttcaaagagttctggatcgagcgtccaaaaccgactgataaacgtttaaccatttatgcattgcttgactcgccgcgcgcgacaggtgcttacaaattcgtagttatgccaggacgtgacacggttgtggatgtgcagtcgaaaatctatctgcgcgataaagtcggcaaactgggggttgcaccgttaaccagtatgttcctgtttgggccgaaccaaccgtcgcctgcaaataactatcgtccggagttgcacgattctaacggtctgtctatccatgcaggtaatggtgaatggatctggcgtccgttgaataacccgaaacatttagcggtcagcagcttctcgatggaaaacccgcaaggcttcggtctattgcagcgtggtcgtgatttctcccgctttgaagatctcgatgatcgttacgatcttcgtccaagcgcatgggtgactccgaaaggggagtggggcaaaggcagcgttgagctggtggaaattccaaccaacgatgaaaccaacgataacatcgtcgcttactggacgccggatcagctgccggagccgggtaaagagatgaactttaaatacaccatcaccttcagccgtgatgaagacaaactgcatgcgccagataacgcatgggtgcaacaaacgcgtcgttcaacgggggatgtgaagcagtcgaacctgattcgccagcctgacggtactatcgcctttgtggtcgattttaccggcgctgagatgaaaaaactgccagaggataccccggtcacagcgcaaaccagcattggtgataatggtgagatagttgaaagcacggtgcgctataacccggttaccaaaggttggcgtctggtgatgcgtgtgaaagtgaaagatgccaagaaaaccactgaaatgcgtgctgcgctggtgaatgccgatcagacgttgagtgaaacctggagctaccagttacctgccaatgaataagacaactgagtacattgacgcaatgcccatcgccgcaagcgagaaagcggcattgccgaagactgatatccgcgccgttcatcaggcgctggatgccgaacaccgcacctgggcgcgggaggatgactccccgcaaggctcggtaaaggcgcgtctggaacaagcctggccagattcacttgctgatggacagttaatcaaagacgacgaagggcgcgatcagctaaaggcgatgccagaagcaaaacgctcctcgatgtttcccgacccgtggcgtaccaacccggtaggccgtttctgggatcgcctgcgtggacgcgatgtgacgccgcgctatctggctcgtttgaccaaagaagagcaggagagcgagcaaaagtggcgtactgtcggtaccatccgccgttacattctgttgatcctgacgctcgcgcaaactgttgtcgcgacctggtatatgaagaccattcttccttatcaggggtgggcgctgattaatcctatggatatggttggtcaggatgtgtgggtttcctttatgcagcttctgccttatatgctgcaaaccggtatcctgatcctctttgcggtactgttctgttgggtgtccgccggattctggacggcgttgatgggcttcctgcaactgcttattggtcgcgataaatacagtatatctgcgtcaacagttggcgatgaaccattaaacccggagcatcgcacggcgttgatcatgcctatctgtaacgaagacgtgaaccgtgtttttgctggcttgcgtgcaacgtgggaatcagtaaaagccaccgggaatgccaaacactttgatgtttacattctgagtgacagttataacccggatatctgcgtcgcagagcaaaaagcctggatggagcttatcgctgaagtcggtggcgaaggtcagattttctatcgccgccgccgccgtcgcgtgaagcgtaaaagcggtaatatcgatgacttctgccgtcgttggggcagccagtacagctacatggtggtgctggatgctgactcggtaatgaccggtgattgtttgtgcggcctggtgcgcctgatggaagccaacccgaacgccgggatcattcagtcgtcaccgaaagcgtccggcatggatacgctgtatgcgcgctgccagcagttcgcgacccgcgtgtatgggccactgtttacagccggtttgcacttctggcaacttggcgagtcgcactactgggggcataacgcgattatccgcgtgaaaccgtttatcgagcactgtgcactggctccgctgccgggcgaaggttcttttgccggttcaatcctgtcacatgacttcgtggaagcggcgttgatgcgccgtgcaggttggggggtctggattgcttacgatctcccgggttcttatgaagaattgccgcctaacttgcttgatgagctaaaacgtgaccgccgctggtgccacggtaacctgatgaacttccgtctgttcctggtgaagggtatgcacccggttcaccgtgcggtgttcctgacgggcgtgatgtcttatctctccgctccgctgtggtttatgttcctcgcgctctctactgcattgcaggtagtacatgcgttgaccgaaccgcaatacttcctgcaaccacggcagttgttcccggtatggccgcagtggcgtcctgagctggcgattgcactttttgcttcgaccatggtgctgttgttcctgccgaagctattgagcattttgcttatctggtgcaaaggaacgaaagaatacggcggcttctggcgcgttacattatcgttgctgctggaagtgctgttttccgtgttgctggctccggtacgcatgttgttccatacagtcttcgtcgtcagcgcgttccttggctgggaagtggtgtggaattcaccgcagcgtgatgatgactccacttcctggggcgaagcgttcaaacgccacggctcacagctgctgttagggttagtgtgggcagttggtatggcgtggttggatctgcgttttctgttctggctggcaccgattgtcttctcgttgatcctgtcaccgtttgtttcggtgatttccagccgtgccaccgttggtctgcgaaccaaacgctggaaactgttcctgatcccggaagagtattcaccgccgcaggtgctggttgataccgatcggttccttgagatgaatcgtcaacgctcccttgatgatggttttatgcacgcggtgtttaacccgtcatttaacgctctggcaaccgcaatggcgaccgcgcgtcaccgcgccagtaaggtgctggaaatcgcccgtgaccgccacgttgaacaggcgctgaacgagacgccagagaagctgaatcgcgatcgtcgcctggtgctgctaagcgatccggtgacgatggcccgtctgcatttccgcgtctggaattccccggagagatattcttcatgggtgagttattacgaagggataaagctcaatccactggcattgcgtaaaccggatgcggcttcgcaataaaaacgtagttgcctgatgcgctacgcttatcaggcctacatcgttcctgcaatttattgattttgcaagattttgtaggtcgggtaaagcgttcaccccgcatccggcaaaaacaacgagccgataaaaataccggcgttatgccggtattttttacggaagaggtatcaaatgcgtttaattgtgatgagcataatggtgaccttgctgagtggctgtggcagcatcattagtcgcactataccggggcaggggcatggcaaccaatattatcccggtgtgcaatgggacgtgcgtgactccgcctggcgttacgtcacgatccttgatctgccattctccctggttttcgatactttactgctgccgatcgacgtacatcatggcccgtatgagtgattaacgttcatcccactcatcagctgcagtgcgtccttcctcggtatccagcggtggctcaagctgaaattccccctcgtcccattcatgtaatgtattctcatcttgccactcctggcggatctctatctcatcatagtcgccgtcaaagacactttgcgcagcttcaccgctaagcatgggtaaacattcaccttcttccccttcgtcggcaaaaaactcaacttgccacatgatgtcgccgtcctgcaaaacgtatttttgggcattgaactgttgcacattcgcgttttcggcgtcgatgccggggttgtctgcaagaaattcttcgcgggcagcgtcaatggcttcttcaagcgttgcgtacatggtcatcacgattctccctttgagttgatgaggtttcagggaaaaggatagctgattctccgcttttgcaagtatgaaaggcgaaaaatcagttcgatatctgggggattcgacgacgacgtagactgttccatgaatagactgcgttgaataacactacgccagcggtgacgagaaataccgccctgaaaccgtagttcgctgaaatcgctgctcccatcaatggtccggtaacgttgccaatatcacgaaacgattggttatagctgaagatacgcccggcgatctggttgctcgagttgtaaaccaacagtgtctgtacggcggggagtaatgcaccatcggcggcaccgagcaaaaaacgtaaaatcccaagttgtaatggcgtctgaacgtaagacattgggatcaacagcagtacagaaaagatcagcgccgtaatcaggatcttttcggggccgattcgatcgccaagtttgccgagtcgtggtgcacttagcagagccgccacgcctggcaccgaggcgatcatgccactgataaaagcgacgttactgacgttacccgccagttcgcggacatacagcgtcagaatgggggcaattgagcccgtcgccacctggatgattaacgtggtgacaaacaggctgagtaccagtttcgggtttttaagtgatgtcaccacttcccgcatatgcagcatctcttttttgctgaccggctggaatttttctctgatgcaaaacagggtgacgaaaaagcagagtatgagcacactggcggtaataaagaataccggacgtaagccgtagctatcggcgagcaaaccgccagccattgggccgagcaacgcgccgctaacgccgcctgtggagagcgtacccagcgcccagccgcttttattacgcggtacttgtgtggcgataagagcattagcgttggggacaaatccgccaagtaaaccaagaagcgcccgcaggatcaaaaactgccagatattttgtgccagtcccatcaacaccatcacgatgcccatgccgagagcagagcgtaatagcatgagttttcggcctttacggtcggcgagtccaccccaaaacggtgaggcgatggccgaaaataaaaatgtaatgctgaagacaataccggaccacatattcagggcggagtggccggtaacgccaagctgctcaacgtagaggggtaagaagggcattaccaggctgaaggcggcaccggtaagaaaacagcctagccaggcgacgatcaggtttcgtttccagtttataggggggtcattttcacagggtgacatagcaatccgctgttggtgcgccaggcgcggtgaacataagaagaaaagataagcacactaattatgcgcccgacttccagggggcgcaatccagagagcttttatcgctaaatcagggggattttctgtggtaatgccggatgccattctgaagcatccagcatggaagatttaatagcgtgaaggaacgccttccgggcgtgttttaaagcgacggtgtaaccacatatactgctctggtgccatcatgatgcatttttcgaccactttgttcatccacgcggcggtagtttcggcatcatccagcggcggagaacactctggcggcagtataatcaactgataccctttgccatctggcttacggcgtggaacgaagggcaccagacatgcgccggacatccgtgccagcatccaggttccggtcgtggtcgcagcctgctcaacggcaaacaacgggacgaaaacgcttgagcgcgggccgtaatcatgatccggtgcgtaccagaccacttcgccttttttcagggctttaatcatgccttttaaatctttgcggtcgagcatcgatttatttgagcgcaaacggccccaggtttgtagccagtcaatcagtggattatcgttcgggcggtaaacgccaatccccggttcctgcataccaaactgccgcgcacccagctccagtgtcagaaaatggatgccaactaacaggatgccgcgtttttgcgcctgcacgtcacgaatgtgttccatgccgatcacttccgtccagcgggcgattcggcggtccggccagaaccacgccatgccggtttccatcaggcccatgccaacggattcgaaattcttcaccaccattttacggcgttcttgttcgctcatttccgggaagcacagttccaggttgcgatgcacaatttttgcgcgtcgtttcataaaacgtaacgccagttttcctaatccacaaccgaggcggtagataaccgggtagggcaattgcacgaccaaccaaagtacgccaatacccaaccaggttaaccaataacgcggatgaagcagtgcggtggagaacttgggtagattcgtcatatcaatcctgtttttcaacctatacgggcaattgtatgtattgtcgcattttttcgtccgcaaccaaaatttgtgactgaagactgggcgaaattgccgcgcttgtaaataacaaataatttttaatgctaaaatgtagcgtaaaatgtgtggatgttaattatcgataattgctatatcatgccgcggatttttactttcccatctcgcaggaaccgtacaccatgccagtgttacacaaccgcatttccaacgacgcgttaaaagccaaaatgttggctgagagcgaaccgcgaaccaccatttcgttttataagtatttccacattgccgatcctaaggtgacccgtgacgctttatatcaactgtttaccgcgctgaatgtttttgggcgagtgtatctggcgcatgagggcattaacgcgcaaatcagcgtacctgcgagcaatgttgaaacatttcgcgcgcagctctatgccttcgacccggctttagagggtttacgcctgaatatcgcgttggatgatgacgggaaatccttctgggtactgcgtatgaaggtacgcgatcgcattgttgccgacggtattgacgatcctctctttgatgccagcaatgttggtgagtatctgcaagcggcggaagtgaacgccatgcttgacgatcccgatgcattgtttatcgacatgcgtaaccactatgagtatgaagtggggcactttgaaaacgcgctggaaataccggcagataccttccgtgagcagctgccaaaagcagttgagatgatgcaggcacataaagataaaaaaatcgtcatgtactgcaccggcggcattcgttgtgaaaaggccagtgcctggatgaaacataacggattcaacaaagtctggcatatcgagggcggaattattgaatacgcccgtaaggcgcgcgagcagggcttgccggtgcgttttattggcaaaaattttgtttttgacgagcggatgggcgaacgtatatctgatgagattatcgcgcactgccaccagtgcggtgcgccgtgcgacagccataccaactgtaaaaatgatggctgccatctgttgtttattcagtgtccagtatgtgcggaaaaatacaaaggttgttgtagtgagatttgctgcgaagaaagcgcgttaccgccagaggaacagcgacgccgtcgggcaggacgtgaaaatggcaataagatctttaataagtctcgtggacgtctgaatacaacactgggcattcctgaaccaacagaataaatatcattgccggatgcgtgccatccggcaacatttcactcttacttctgctgtacgccttccactgaaataatcagatccacttcctgagacgctggacctaaatctgtcttgatattgaagtctttgagctcgattttgccttcggcctcaaagcctgcacgtttaccgccccacgggtcgtcaccctgaccaattaatttcgcttccagtgtgacgggcttggttacaccattcagcgtcagatcgccggtaatatccagttcgtcaccgtctttcttcacgctggtggaggtgaatgttgcctgtggatattttgcggtattgaggaaatccgcactgcgaagatgtttatcgcgttcggcgtgattagtatcgacgctggtggtgttaattgtcacattcactttatcggcagctggatttttttcatcaaaggtaaaagtaccgtcgaaatctttgaaggtgccatataaccagctatagccaagatgctggatgcggaagttaacaaaggcgtgctgaccttctttgttaattttgtaatcggcggcaaccgctgaaccggcagagaacatcaaggaagcgaaggttaaaccaagcaggctttttttcattttttatactccatagtcagatgacgactttcccagcatgcgcttcagagtgtcgtctttatcgatgaaatgatgcttcagggccataaatccgtgcataacggacagtactacgacgctccacgcgagccaaaaatgcagggcaccggcaaagtcagcctgtgcgccagcgtcggcgagggtcgcggggacgtcaaaccagccaaaaacgctgatcggtttaccatcggcagttgagatcagatagccgctgatgccgatggcgaacagcaataggtacaatgcgagatgtccagcttttgctgcaagacgagtcatgggcgaataactcggcagcggacccggcggtggagatatgacacgccacagaacgcgaataaccagccccatcattaacaaaataccgatgcttttatgcagttcgggtgctttgtgataccagccatcgtaataactgagcgtgaccatccacagacctaaagcaaacatgccgtagacaataattgcgcttatccaatgtaaggccgcagatataacaccatagcgttcaggggtatttgtgaatgacataagtacatccaaaacgaatttgcgagagaaagaaaatggcgtgtcggagaatgaattgcaacacaaaaataacaaattgaatgatatttatttttatttcaataattttgaattaataatgaaagaatcttcataagtttagtgggttaagcatctggaaggtctagtgagtgctgtagaggcaggaagaatctcattcaatttttcacgctaaatgaaagggagattaaatatttgtcagtttatgtcagtgcggaaaactaaaaataaaacacatagatcagatccataattgccaacaatccccagagaaaaagataaagcatcagatgctcgcgaatattattgatgagatagtgcaacagtcgacgcattaaatactcctgtaaaaacggcctcattctggaggccgtaatgatgattattggaagcgggaaagcctgaatggcgtcaaatcaaaatcgctttttttgtcttgcgcaaaatcggcagctatttcccctaaaactgacgcaaatttaaaaccgtgcccactcaggccggtaatgagcagtgtattatcgtggccgggtagggtatcgataataaaatcttcgtcaggcgaattatcataggtgcaggcagcgccgtacaggcagcaaccgatacccggcaacacattgcgcaagaacgggaaggcttccgaaccatcgctgaccacttccgcaaacggaacacgttcatccgctgaatggataacctggcctccgttatgtttgccaatcttcaacgcgtcgttttctgccggaaaaccataatattgatcgccattgggcagttcaccggtaaacgccgggaatttattcttcacgctatagcgaccatcggcctgataccaggcaaatactttgcgtacgggctggacaggcagctccgggagtaggtcttttacccatgttcccgcgcagacaatcgcttttttcgcctgatacacaccgtcagccgtttcaatagttacgccatcatcgtcatgacgaattgcggtgaccgggcagttgaacagctgcgcacagcccgcttccttcgccagttggatccaggttttaatcgccagttcgctgcgcaaaaaaccagaatcagtttcaaataaaccgatgtagttgtccgggacgcgtatttctggccagcgggccataatcccttgcgcgtcgagcttttcaacgttgagttgccactgttcggcgctgtgggcgacgttggcgagaaatgcggagtcagccggaccgaggttaatgacaccagagcgtacaaaaatgggatcatcttcgttgtggcgggaaagttcatcccacagcatttgcgcgcggaggaccagcgggacatacttttcaccttcaccataagcatggcgaattaatcgcgtatcgccgtggtggctgccgtgttgatgcggtggcatatgggcgtcggtcattagcacgtttaaaccggcgcgggttgcataatacccggcggcagcgcctacggaaccgctgccaataatgatgagatcgtatttcatttttttctctctgctctcatggtttaagcagagtaattaactgaatgcagatatacaacccagaaatggtaaaggcaccggtgaggtgccttttgggtggatggtcatgtcatgttaatgacgccgatactcgtttacctggaaatcaccggattcaattttggcgattcctgcttctaatatcgaaataaattgtctggcaacatcagtggttaaccagagcgtctgaccaacttcagtcccttcctgctcggacttatttggggtctggtagtgcaaacgcagcatcagcgcatcatagctatcaacggtgctgatgtcccaccctacgagcggatgagtctgaatgacttcattatttttttccatcatggccccctaattcgtgttactagacaacgttattcgaggttcaatgcgtttttatctgaagcaacttcagtataccaataagtaagggtattcaccgaatttttaaaggggggaacagataaatttctgcttttaagatttatatgaacaataaaacagcatgtcattcatatttttttagcatattgtgcaattattttgaggaagtgtagaaattttgtactcacaattcgcaagtaaaataaaaaagccggggcgacccggcaaaaacaaaaatcactgcatattattcgctgacaaaccagtcatcggcgctttcccacgtttcctggagaatttcgctaatgcgctgtttatcttcttttgtcgcgccaataaccgataaattatttgctgcggcataacgtaccgatacgtggccttcattatcaggaaacgcatactgaatacggcgggaaagttcgccagccagggcgtcaatagccccagctggcaatggagaagttttcgctatggtgacttcaattcgcataatagccccctattgaatacactggttatttatacaggtaaaataacctaatgacaacaggaagctacgatttttattgtttaacggaccagcgtaccgtttctccggcgaggaatggcaccagcgtgtcatcagtcagtgcgatgctttcagcaacctgttgctcttcacgtaccagttcgatgaatgtgtcgttgaccggcaagccatagaactgcgggccgtttacagaacagaatgcttcaaagtgctgcaaagcattcatctcttcaaagacggtagcgtaactgcccagcgcggttggggcgttgaaacagcccgcgcagccgcagctgctctctttgcgatgacgtgcatgtggcgcagaatccgttccgaggaatacacgattaaaaccgctggcgaccagttcacgcaatgcctgttggtggatattgcgtttgaggatgggtagacaatacaggtgcggacgcacgccaccaaccagcatatggttgcggttaaacatcagatgctgcggagtgatggtggcagccagccgttcatttccgtcacggacatagtcggcagcgtctttggtggtgatatgctcaaaaacgactttcagcgcggtcaggcgctggcgcagcggttccatcacgctttctataaagcgcgcttcacgatcaaaaatgtcgatatctgcatgtgttacttcaccatgcaccagtagcggcataccgattttttccatgcgctcaagtaccggcatgattgcgtcaactgacgtaacgccgtggctggagttagtggttgcgtttgccggataaagttttgcagcggtgaacacgccttcgttaaatccgcgctccagctcattaggatccagcgaatctgttaaataacaggtcatcagcggggtgaaatcgtgcccggcaggtacggcgtcaagaatgcgctggcgatacgccacggcagcctcaacggtggtcacgggcggagccagattgggcattacgatagcccgtccataaatttcgctggtatacggcacgacagtttttaacatgtcgccatcgcggaggtgaaggtgccagtcgtctgggcggcggatctttaatacctgggatggtgcagtcattaatctctatgctccggctgaagggatgtttttgccggacacaaaggataagcggaaacgttttcctttgcacgaaaaataaagggcgcgaatgcgccctcgtgattaatcagtaaacggaatgacaatttcgcctggcttcacttcaatgcctttcgccagtttcttcgccattgcttcgccctggctgccatcttcgcgcaggacgtaagcaggttgctggttaaagtaattgcgtaatgcctggtttaaatagggaagcaacgtttgcatcaccgtttgcattttttccggttgtaccgtcgcatcgaccacttccatctctttcaggaagatcgcgcctttttctttatcaaacacgggcagcgctttcagcttcagtttcatggtcgctttctggctaccgaacagggagttcatgtccagattggcgtctccggttagggtaaccttattcggctcttcgcgaccaatttggctggtcaggtttgtcagaacaatatgggcgtcagccacgccgggtaaaccgatatcttttgagaaattattatgtttcgcaagcgactggttaatttcttgttcggtgatggtgtattgggtgagttgattacagccaacgagcaggccactgacgatcaatgcagcggcaaataaaaacttgttcatggtagtcctcgacatgaaatctgcgtcaatatcctgacacaacgcagcatgtgtcaccagcgataaacgcgccagcagaaaaaactgaaaacggcggcaacccgcgaatacaggctgccgcggcgggtcaggattaaatcgccattgatgataacaaattgatttgtgtctgtttcgccatattatcgcggtaatcagcaacgcggcttggccagttgattccggctactagcgtcagattacgcaggagcggaaatagctgaatatcatcttccgaaagttcgccattcacggcgttcggtttgacgatcagtttgtccagcgcacgtaaatcatcgctgatattcttaatcagaccgtcagagtgggccagcaggtcggcaaaattacccgcgctggcctctttcttgtcgacgaaatatttgcgcgcggcaggagtagaaaactcatcaaatgccgatttggcaaaacgcggcaacagcagtttgttggcgtagccattgaccttgcgcagccactcttcaatggcaggggaacgtttgccggtcagtaacggtttgccgtcgagtttatcgacatagtgaacgatgtccatgctttctggcatatagcggctgtcatctttttgcagaatgggaacctgtttttgaccgaccatccgggtgggtgtttctgcgtcgtcgttgagcagaacatgtaattcgacggggatatttttcaggccgaaaatcatgcgggctttgaggcagtaagggcagtgatcgtaaatgtatagcttcacgtgactcctccatttggctgtcagttcactttcagtatggaggagtcaggggggagtatcaaatcaggcgtcgcgttcaagcaaacgacgcgcggcgcgtttctggctaaactgccaacccagcgcaaggaaagtgaagatgccaataatgcccagcatcatccacggaagctctggctggtgcgccgatttgcccaggtcaaacagccagccgccaccgatataaccaatagcgccgccaatcgccagacccagacggctaaaccccatatagctgccgcgagctcttgcgtctgccagcgaagcacttaaggtttcacgcgcaggctcggcaatgatcgacccgatataaaacagacaaatcagggtgaaaagttgttgcaggccgctgaccatgcctactggcatcatgcttaatgacattatcaacagcccagccattaaccggtgttccagacgaaaatgcttttcactccagcgggcgatagggtagagcaacgttaacgacagacacgcttcaatggcatacatccatttaacggcagagggcgcgccagccacgtcgttgaccataattggcagcatcagcatcacttgtacagccagcatgtagtaacccgccagcgtcaggacataggtgacaaaacgcttgtcgcgcatcacgcgggtcatgccttcgcgaacgggcgtgcgcacggtggagagtttccatgccggtaacaaccacgcattgaacgctgcacacagcacaaacaaaactgcccctgtggcgcagaccaggcgaaagtcgtattgcaacagccagctccccaacaatgcgccaatgaccgcaccggcactgtcctgcatcatcaacagcgagaaaaaacgaccacgctgctgtggacggattaatttcaccaccagcgccgaacgcggaggatcaaacaacgtgccgccgagtcccgaaagcaggcatgaaaaccacagtagccacggttcgtgggcgatacccattgtggcgaatccggcggcacgcatcagcataccggtgacaatcatcggtttggcaccaaagcggtcggcaattgcgccgccgaaaatacccagaccttgctgaataaactggcgtagaccgagggcaataccgaccatgacggcggcccagcccatttgatcaacgaagcggatagagatcagcgggaagacaacaaagaaccccagcacgaccagcatattatcgatgagcaggaaatatttacccaggttcctcgcctgcgacacgcgggacatttcccctcccgggaaataaaagatgagcactttctattctgcattgccgctaagacttttcccatcacttcggggacaatatttttttatcaaaacgtcgctttgatagagagtttttatcaaatatgtgaataatgcagaaaatggcattctggacttttcacagggtctggttgcgcaggtatagtaatacttacagcgtattaaagacgttacgggaaggagtaggtatagaatgtttggctatcgcagtaacgtgccaaaagtgcgcttaaccacagaccgactggtcgtgcgtctggtgcatgatcgtgatgcctggcgtctggcggattattacgcagagaatcgccatttcctcaagccctgggagccagtgcgcgacgaaagccactgttatccatcaggctggcaggccaggctagggatgattaacgaatttcataaacaaggttcagctttttactttggcttattcgacccggacgaaaaagagattattggcgttgccaatttttccaatgttgttcgcggctcttttcatgcctgctatctcggttattcgattgggcaaaaatggcagggcaaaggactcatgtttgaagccctgaccgcagccattcgttatatgcagcgcacccaacatattcatcgcattatggctaattatatgccgcacaataaacgcagcggtgatttactggcgcgactgggttttgaaaaagaaggctatgcgaaagactatctgttgattgatggacaatggcgcgatcacgtactgacggcattaactaccccagactggacgcccggccgctaaggagaatctcatgaaatatcaacttactgtcatggaagctcgcgtgattggttgcttgctggaaaaacaggtgaccacgccggagcaatacccgctctccgtaaatggtgtagtcacggcctgtaatcagaaaacgaaccgtgaaccggttatgaatctgagtgaatctgaagtgcaggaacagctggataatctggtcaaacgtcattatctacgcacggtgagcggttttggtaatcgggtcaccaaatatgagcaacgtttttgtaattcagaatttggcgatctgaaactgagcgccgcagaagtggcgttaatcaccacgttgttattgcgtggtgcccagacgccgggggaactgcgcagccgcgccgcgcgaatgtatgaattcagcgatatggcggaagtggagtcgacgctggaacaactggcgaatcgcgaagatggtccttttgtggtgcgtctggcccgcgaaccgggtaaacgcgaaagccgctacatgcatcttttcagtggtgaggttgagaatccgccggcggtaacggatatgtcgaacgcagctgacggtgatttacaggcccgcgtcgaagccctggaaatcgaagtggcagaactgaaacagcgtcttgattcgttgctggcccatctgggagattaaagtgaaaaaattacgtatcggcgtagtggggttaggcggcatcgcgcaaaaagcgtggttaccggtgctggcggcagcgtctgactggacgttacaaggtgcgtggtcgcctacgcgcgccaaagccttgccaatttgtgacagctggcgcattccttatgctgattcgttatccagccttgccgccagttgcgatgcggtttttgtgcattccagcaccgccagccactttgacgtggtcagtacgttactcaatgcgggggtacatgtctgtgtcgataaaccgctggcagaaaatctgcgcgatgctgaacggctggtggaactggcggcgcggaaaaaactgacgttgatggtcggttttaaccgtcgtttcgcaccactctacggtgagttaaaaacgcaactcgccaccgcgtcctcgctaagaatggataaacatcgtaccaatagcgtcgggccacacgatctttatttcacattgctggatgattatttgcatgtggttgataccgcgctgtggttgtctggcggcaatgcaactctcgaaagcggtacgttgctgaccaatgagtccggcgaaatgctgtttgccgagcaccatttttcggctggtcctttgcagattaccacctgtatgcatcgccgtgccggaagtcagcgtgaaaccgtgcaggccgtgactgatggtgcgctcatcgacattacggatatgcgcgaatggcgtgaggagcgcgggcagggcgtagtgcataaaccgattcctggttggcagagtacgctcgagcaacgtggatttgtcggctgtgcgcggcacttcattgaatgcgtgcaaaatcagacagttccgcaaaccgccggcgaacaggccgtgctggcgcaacgtatcgttgacaagatctggcgcgatgcgatgagtgaataaaccctgtaacatctggcggtagcaattcaccataatccaggtagactattcgcctctttcagcgcctgccttgcaggcgttttgcccgtgggtctggattagaacaccgatgaatttattaaaatcgctggccgccgtcagctcgatgaccatgttttcgcgtgtgcttggcttcgcacgagacgcaattgtcgccagaatctttggcgcagggatggcaaccgacgcctttttcgtcgcttttaaacttcctaacttgttacgccgtatctttgccgaaggggcattttcccaggcatttgtaccgattctggcagaatataaaagcaagcagggtgaagacgccacgcgggtctttgtctcttatgtttctggcctgctgacacttgcgctggcggttgtgacggtcgctggcatgctcgctgcaccgtgggtgatcatggtgaccgcgcctggcttcgctgacactgccgacaaatttgccctgaccagccagctactaaagataacctttccctatatcttgctgatctccctggcgtcgctggtgggagcgattctgaatacctggaaccgcttctcaattccggcgtttgccccgacattgctcaatatcagcatgattggttttgcgctgtttgccgcgccgtactttaatccaccggtgctggcgctggcctgggctgttacggtcggcggcatcctgcagctggtgtatcagctacctcatctgaagaagatcggcatgctggttttgccacgcattaacttccacgatgccggagcaatgcgtgtggtgaaacagatgggaccggcaatccttggcgtctctgtgagccagatctccttaatcatcaacaccatttttgcctcgtttcttgcttccggttcggtgtcgtggatgtattacgccgaccgcttaatggagtttccgtccggtgtgctgggcgtggcgcttggcaccattttgctaccgtcgctgtcgaaaagttttgccagtggcaatcatgatgaatacaaccgtttgatggactgggggctgcgtctttgtttcctgttggcgctgccgagtgcggttgcgttgggcattctttccggtccgttaaccgtttcgctgttccagtacggtaaatttaccgcctttgatgcgctgatgacccagcgggcgttaattgcctactcggtgggtttgattggcctgattgtagtgaaagtgttggctcctggcttttattcccgccaggacattaaaacgccagtgaaaattgccatcgttacgctgattttaacgcaattgatgaacctggcgtttattggtccgttgaaacatgccgggctgtcactttctattggtctggcggcgtgtctgaatgcttcgctgctttactggcagttgcgtaagcagaaaatctttaccccgcaacccggctggatggcgtttctgttgcgtctggtggtggcggtactggtgatgtctggcgtgcttttaggtatgttacatatcatgccggagtggtcattgggtaccatgccctggcgtttactgcgtttaatggcggtcgtgctggcggggattgccgcgtatttcgctgcactggcggtactgggcttcaaagttaaagaatttgcccgccggacggtgtaacgatacattccggcccgcagtgcaggccggagttaatcttcagatcgaaatctttttactgccgcgatgggttgttgaggtctgaccgttcgccccatacagcgtcggttcctgatgcggtttcaacatttccagcgcctgttgattgcgttcaatctgtccttccagtaaccagccgttatgttgattcagttggcgtagttgctgcgttttgccagtaatttcctgccagcgttgactaatatcaacgctatttgctgtattgggttctttcctgcgtaactgttcgaggtaatccagcgtcgccagcagtgagcttttttgttctgtaatccattgcaactggctgccgttgatctgccccatagagagatgttgctgctcttgatccattaccgttttgagatcgttaagcacagcggacatctggtcgaggatctctgcaagacgcgtcatacgatcaattactctgcaagtcttgctgcgcttcgttgatcagcgcatcggcaattttgccggtgtccatttttagttcaccgttacgaatcgccagctttaacgcttcgacacgttcaagattgatatcactgctgccgggttgcatcagttttgcttgcgcgtcgcttaacgtcacactggtgctggtggaggcggttgtttttgccgcccgggtgtttgttaccggcgcgtcagtggtttcgcgcggttgaacggtgcttactggcttcagaggcgaagtgcgatcaatactcatggtttattcctcattgagggcgcttttatcatgtgttgcttatttatcggcaagggacgggtaatctttaacagcttacaggtttataagaatattcccatctgcatcaacaacgccgctgaccacttgtcccgatatcatgcgcacccgcgcattctgtgcgacggctgcattgttcagcgcctgaccttctgcgttggcgctaaacccatcaccgctggcgatcacgttgacacgttgtcccgcttttacccgccatgcctggcgaaagtgggttaactggataggttgatcgggtgatagatcgcgcaggctaacggcatcaacaagttgattgatatccagcaccgtacgcggtggcaaggtatccagccgtccgcgtttcagtttgacattgccagcttccagctttcctccacgcacaatgggcatcgcggcaaccacataatttcctgtggcctgcacattaacctgtaaatatcgtttgtcgttaccgcagcgtgccaacacattcacattgccccacagacgggaattattgctcatcgaaagcaatggctgatcgcacggcggtagcagattgggtgctgtacgaatagaaacacgaacctcatcacttacccccgcgagttgggcgctaaaaaagttgtgcaattgcgatgtgagattgctcgccgtacttaacggactgaacagtatcgcgatgatcgccacgctacgttttattgtcagcattttcgtccccagccatttctacaacgtgaattgtacctgtccgcaatgaccatcaacggcataaatagcgacccattttgcgtttattccgccgataacgcgcgcgtaaaggcatttaagctgatggccgaattttgatacctgcggaggagatatgctcgataagctcgacgccgccttacgttttcaacaagaggcgctcaatctgcgcgcccagcgtcaggaagtgctggcagcaaacatcgccaatgccgatacccctggttatcaggcgcgcgatatcgattttgccagtgaacttaaaaaagtcatgcaacgtggacgggatgcaaccagtgtggttgctctgacgatgacctcaacgaaacacattccggcgcaggcgctgacgcctcctaccgcagaactgcaataccgtattccggaccagccttcgcttgacggtaatactgtcgatatggatcgcgaacgcacccagtttgccgataacagcctgcaataccagatgagccttagcgcgttgagcgggcagatcaaaggcatgatgaacgttttacagagcggaaattaacggatggcactgctgaatatttttgatatcgccgggtcggcgttaactgcccagtcccagcgcctgaacgtggcggccagtaatctggcgaatgctgatagcgtcaccggtcccgatggacagccatatcgggcaaaacaggtggtattccaggttaacgctgcgccaggtgctgcgacaggcggcgtaaaggttgccgatgttatagaaagtcaggctccggacaaactggtttatgaaccgggtaatccgctggcggatgcaaagggctacgtgaaaatgccaaacgttgatgtcgtcggagagatggttaacaccatgtcggcgtcacgcagttatcaggccaatgttgaagtgctcaacacggtgaaaagcatgatgctgaaaacccttacgctcggtcaataaaggagaaagctatgtctattgcggtaaccaccaccgatccgacgaataccggcgtcagtaccaccagcagtagttcgctcacgggcagcaacgccgcagatttacaaagcagttttctgactttgttggtggcgcagctgaaaaaccaggacccgaccaatccaatggaaaacaacgagctgacgtcgcaattggcacaaatcagcacggtcagtgggattgaaaaactcaataccacgctcggatctatttccggacagattgataacagccagtcgttacaggccagtaaccttatcggtcatggcgtgatgatccccggtaccactgttcttgcgggaaccggcagtgaagaaggggctgtgaccacgaccacgccgtttggtgttgagttgcaacaggcagcagacaaagtgacggccaccatcaccgataaaaacggcgcggtcgtccgtaccattgatatcggtgaactgactgccggagtccatagtttcacctgggacggtacgttgactgacggcagcactgcgctgaacggttcttacaatgtagcgattagcgccagtaacggtggtacacaactggttgcccaaccgctgcagtttgctctggtgcagggggtgatccgcggcaacaacggtaatacgctggatctcggcacttacggcaccactaccctcgacgaagtacggcagataatttaagccttcacatttcaggagtcagtcatggccttttctcaagcggttagcggattaaacgctgccgccaccaacctcgatgttattggcaacaatatcgccaactccgccacctacggctttaaatcaggcacggcctcttttgccgatatgtttgccggttcgaaagtgggactgggggtaaaagttgctggtatcactcaggactttaccgatggcacgaccaccaacaccgggcgtggtctggacgttgctattagccagaacggttttttccgtctggtagacagcaatggttcggtgttctacagccgtaacggacaatttaagctggatgaaaaccgtaacctggtgaatatgcaaggtttacagctgacgggttacccggcaaccggtacgccgccgactattcagcaaggggcgaatccgaccaatatttcgattccgaataccctgatggcagcgaaaactaccaccacggcgtcgatgcagatcaacctgaattccagtgattcgcttccctctgttaacgcatttgatgccagcaatgcggatagctataacaaaaaaggttcggtgactgttttcgatagtcagggtaatgctcatgacatgagcgtctactttgtgaagaccggggataataactggcaggtctacaccctggatagcagtgatccaacaggcacagctaaccctgcaacgacgctggtgtttaatgccaatggcgttctgacctcaaatccaacagcgaatatttccactggcgcaattaacggcgcagatcccgccacgtttagcctgagcttcctcaactccatgcagcaaaataccggcgctaacaacattgtggcaaccacccagaacggctacaaaccgggcgatctggtgagttatcaaatcaatgatgacggtacggttgtcggcaactattccaacgaacaaacccaactgctggggcagattgtactggcgaactttgccaacaacgaaggtctggcatccgaaggcgacaacgtctggtccgctacgcaatcttctggcgtggcgctgttagggacagccgggacgggcaactttggcacactgaccaacggtgcgctggaagcgtccaacgtcgatctcagtaaagaactggtcaatatgatcgttgcccagcgtaactatcagtctaacgcccagaccatcaaaacccaggaccagatcctcaacacgctggttaacttacgctaatcgctgacgggatagctcaatggatcacgcaatttataccgcgatgggagcagccagccagacgctgaatcaacaggcggtaaccgccaataatctggccaatgcctcaacgcccggttttcgcgcgcagttaaacgccttgcgcgcagtgccggtggaagggctttcactgcccacgcgcacgctggtaacggcgtcaacaccgggtgcagacatgacgcccggcaagatggattacacctcgcgcccgctggacgttgcgttgcagcaggatggttggctggccgtgcagaccgctgacggcagtgaagggtatacgcgtaatggcagcattcaggttgatcctaccgggcaactgacaattcagggacatccggtggtaggcgaggcggggccaattgctgtgccggaaggggcggaaatcactattgctgccgatggcacaatctcggcgctgaatccgggcgatccggcaaatacggttgcgccagtggggcgtctgaagctggtgaaagccacgggcagcgaagtccagcgcggtgacgatggcatttttcgtttaagcgcagaaagccaggctaggcgtgggccggtactgcaggcagatccaaccttgcgtgtgatgtcgggggttctggaaggcagtaacgtcaatgccgttgcggcaatgagcgacatgattgccagcgcacggcgttttgaaatgcagatgaaggtgatcagcagcgtcgatgataacgcaggccgtgccaaccaactgctgtcgatgagttaattgaaaggatacatgacaagtataagttgccctatgcgcaagtttatcgggtctatgggggcaatcgcaatttatcgattttgcgagttcttgtaggccggataaggcgtttacgccgcatccggcaagaagacatatgcactttgtcactaatccactacaggacattttatgatcagttcattatggatcgccaaaacgggccttgacgcccagcaaaccaatatggacgtcattgccaacaacctggcaaacgttagtaccaacggttttaagcgtcagcgcgcggtgtttgaagatctgctttatcaaaccattcgccagccgggggcacagtcttccgaacaaaccaccttaccatccggattacaaatcggtacgggggtacgcccggtcgccacggaacgtttacacagccagggcaacctgtcgcaaaccaataacagtaaagacgtcgcgattaaagggcagggctttttccaggtgatgttgccagatggctcatcagcctatacccgtgacggctctttccaggtggatcagaacgggcagctggtgacggccggtggttttcaggtgcagccagcgatcaccattccggcgaatgcgttaagtatcaccatcggtcgtgatggcgtggtcagcgtaacccaacaaggccaggcagctccggttcaggttgggcagctcaatctcaccacctttatgaatgacaccggactagagagcattggcgaaaacctctacaccgaaacgcaatcctccggtgcaccgaacgaaagcacgccgggcctgaacggcgcgggactgctgtatcaagggtatgttgaaatgtctaacgtcaacgtggcggaagaactggtcaatatgattcaggtgcaacgcgcttacgaaatcaacagtaaagcggtgtccaccaccgatcagatgctgcaaaaactgacgcaactctaaggcttaaccggtggcaggttcaccggtttactgatttttgaagatgatagccatgcaaaaaaacgctgcgcatacttatgccatttccagcttgttggtgctttcactaaccggctgcgcctggataccctccacgccgctggtacaaggggcgaccagtgcacaaccggttcccggtccgacgcccgtcgccaacgggtctattttccagtctgctcagccgattaactatggctatcaaccgctgtttgaagatcgtcgaccacgcaatattggcgatacgctgactatcgtgttgcaggagaacgtcagcgccagcaaaagctcctctgcgaatgccagccgtgacggtaaaactaattttggctttgatactgtgccgcgctatttgcaggggttgtttggtaacgctcgtgccgatgtcgaagcctccggtggtaacacgttcaacggaaaaggcggggccaatgccagcaatacctttagcggtacgttgacggtgacggttgaccaggtactggtcaacggcaacctgcatgtggtgggtgaaaaacagatcgccattaatcagggtaccgaatttattcgcttctctggcgtggttaatccacgcactatcagcggcagcaataccgtaccatctactcaggtggcggatgcgcgcattgaatacgtaggcaatggctacattaacgaagcgcaaaatatgggctggttgcagcgtttcttccttaacctgtcgccaatgtaagtgaggctgtggtgattaaatttctctctgcattaattcttctactggttatcacggcggctcaggctgagcgtattcgcgatctcaccagtgttcagggggtaaggcaaaactcactgattggctatggcctggtggtggggctggatggaaccggtgaccagacaacccagacgccgtttaccacacaaacgcttaataacatgctctcacagctgggaattaccgttccgacgggcaccaatatgcagctaaaaaacgtcgctgcggtaatggtgacagcgtcacttccgccgtttggacgccaggggcaaaccatcgatgtggtggtttcttccatgggtaatgccaaaagcttgcgtggcggtacgttgttgatgacaccgcttaagggcgttgacagtcaggtgtatgcgctggcgcagggtaatattctggttggtggcgctggagcctccgctggcggtagcagtgttcaggtgaaccaactgaacggtggacggatcaccaatggtgcggttattgaacgtgaattgcccagccagtttggcgtcgggaatacccttaatttgcaacttaacgacgaagatttcagcatggcgcagcaaatcgctgacaccatcaaccgcgtgcgtggatatggcagcgccaccgcgttagatgcgcggactattcaggtgcgcgtaccaagtggcaacagttcccaggtccgtttccttgccgatatccagaatatgcaggttaatgtcaccccgcaggacgctaaagtagtgattaactcgcgcactggttcggtggtgatgaatcgcgaagtgaccctcgacagctgcgcggtagcgcaggggaatctctcagtaacagttaatcgtcaggccaatgtcagccagccagatacaccgtttggtggcgggcagaccgtggtaacgccacaaacgcagatcgatttacgccagagcggcggttcgctgcaaagcgtacgttccagcgccagcctcaataacgtggtgcgtgcgctcaatgcgctgggcgctacgccgatggatctgatgtccatactgcaatcaatgcaaagtgcgggatgtctgcgggcaaaactggaaatcatctgatgatcagcgacagcaaactactggcaagtgcggcctgggatgcacaatcgctcaacgaacttaaggcgaaagcgggcgaagatccggcggcaaatatccgtccggtggcccgccaggtggaagggatgttcgtgcagatgatgttgaaaagcatgcgcgacgctttaccaaaagatggcctgttcagcagcgagcgcactcgcctgtataccagtatgtatgaccagcagattgcccaacagatgacggcgggcaaaggtctggggctggcagagatgatggttaaacagatgacgccagaacaaccattgccagaggagtccacgccagcagcaccgatgaaattcccgctcgaaaccgtggtgcgttatcaaaatcagacgctttcgcagctggtgcaaaaggccgtaccacgtaactacgatgattcgctgccgggtgacagtaaagcattcctcgcgcaactctcgttgcccgcccaactggcaagccagcaaagcggtgtgccacatcatttgatcctcgctcaggcggcgcttgaatctggctggggacaacggcaaatccgccgtgaaaacggcgagccgagctataacctgtttggcgtcaaagcctctggcaactggaaagggccagtcactgaaatcaccacgactgaatatgaaaatggcgaagcgaagaaagtaaaagcgaagtttcgggtctacagctcgtatctggaagcattgtcggattacgttgggctgttaacgcgtaacccgcgctacgccgccgtgacgaccgccgcgagtgcggagcagggggcgcaggccctacaggacgcgggctatgccaccgatcctcactatgcccgcaaactcaccagcatgattcagcagatgaaatcgataagcgacaaggtgagcaaaacctacagcatgaacattgataatctgttctgaataactcaagtccggcgggtcgctgccgataatactctgtaattgaaggcttataaggaacctccatgtccagcttgatcaataacgccatgagcggactgaacgcggcccaggcggcgttaaatacggcaagtaataatatctccagctataacgttgccggatatacccgccaaaccactattatggcgcaggccaatagcacgttgggcgctggcggctgggttggcaatggcgtctacgtttctggtgtgcagcgtgagtatgatgcgtttattaccaaccagttacgtgctgcgcagacgcaaagtagcggcctgactgcccgctatgagcagatgtcgaaaatcgacaatatgctctccaccagtacctcttcgctggcaacacagatgcaggatttcttcaccagcctgcaaacgctggtgagtaacgcggaagacccggcagcgcgccaggcgctgattgggaaatcagaagggttggtgaatcagtttaaaaccaccgatcaatatctgcgcgaccaggacaaacaggtcaatatcgcgataggtgccagcgttgatcagatcaacaattacgctaaacaaatcgccagcctgaacgatcaaatctcgcgtctgacaggcgtgggggcaggggcgtcacctaacaatctgctggatcaacgcgatcaactggtgagtgaattaaaccagattgttggcgtagaagttagcgttcaggatggtggcacttataacatcacgatggccaatggctactcactggttcagggaagtacggcgcggcagctggcggcagttccttccagcgctgacccttctcgtacgactgtcgcttacgttgatggtacggcaggcaatattgagatcccggagaaattgctgaataccgggtcgctgggcggcattctgacattccgttctcaggatctggaccagacgcgtaatacgctcggacaactggcgctggcatttgccggggctttcaacacccaacacaaagccggatttgatgctaacggcgatgccggtgaagatttctttgctatcggtaagcccgcggttctgcaaaacacgaaaaacaacggtgacgttgcgatcggtgcaacggtaactgatgcctccgcggtactggcgacagattacaaaatctcgttcgataataatcagtggcaggtcacccgccttgccagcaataccacttttacggtgacgccggatgccaacggtaaagtggcatttgatggtctggagttgacgtttacaggaacgcctgccgttaacgacagcttcacgttgaaaccggtaagtgacgccatcgtcaacatggatgtattaatcactgacgaagcgaaaatcgccatggcgagcgcagaagatgcgggtgatagcgacaaccgcaacggtcaggccctgctggatctgcaaagcaacagtaaaacggtgggcggtgcgaaatcctttaacgacgcttatgcctcgttagtgagtgatatcggtaataaaaccgcgacgttgaaaaccagtagcgccacgcaaggtaatgtggtgacgcagctttccaatcagcagcagtcgatttccggtgtcaatctcgatgaggagtacggaaatctgcaacgttttcagcagtattacctggcgaatgcgcaggttctgcagacggcaaacgcgatttttgatgcgctgattaacattcgctaaggggagataaaatgcgtttcagtacccagatgatgtaccagcaaaacatgcgcggcatcaccaattctcaggcagaatggatgaagtacggtgaacagatgtcgacgggtaagcgagtcgttaacccttcagatgatcccattgctgcatcacaagctgttgttctctcccaggcacaggcgcaaaacagccagtacacgctggcgcgtactttcgccactcaaaaagtgtcactggaagagagtgtacttagccaggtcaccaccgctatccagaatgctcaggaaaaaattgtctacgccagcaatggcaccttgagtgacgatgaccgggcctcgctggctacggatattcaggggcttcgtgaccagttgctgaatctggcgaacaccactgacggtaacgggcgctacatttttgccggttataaaacagaatccgcaccgtttagcgaggcggatggcaaatacgaaggcggagcagaaagtattaaacaacaggtcgatgcttcgcgttcgatggtgatagggcacacgggtgacaaaattttcgacagtattaccagcaacgcggtagcggaaccagacggtagcgcttctgaaaccaatctttttgccatgctggatagcgccatcgcagccctgaaaacgccggtcgcggatagcgaagcggataaagaaaccgccgctgcggcactggataaaaccaaccgcggactgaaaaactcgctgaacaatgtgctgactgttcgcgcggaattaggcacgcagctgaacgaactggagtcgctggattccttaggtagcgatcgcgctttagggcaaacgcagcagatgagcgatctggttgatgtggactggaatgcaactatttcatcttacatcatgcagcaaacggcattgcaggcgtcgtataaagcatttaccgatatgcagggattgtcgctcttccagctcaacaaataatttcgctttaaaacatatcatgaaactgggtatgttttgtctgcctgctccgggatcgccggggcgggcatttttttgcctattttgtattgttggttagcaaggatgccatttgatgaattttaatatgttgactcaaagatgaaataaaaaagccctggtagttaccagggcttgattacttgagctaattattactcaacaggttgcggacgcgcaggagcggcagatgcatgatgcgttgccgtatgaccacctgcggcacctttaccttcgaaggcgaaagtagggcgctgccagtcactgtgacgcggtgcttccggaacatattccggtgccggagcgcgcgtcatcggcgcggtagcgtggttatgctcaacggtgacctcaggttcaaccgcagctaccgtttcaacttctgctgcgacttcagcgacgactggcgcggcaggttgagcaacaacttcaggttcagcaaccacaacctcagcagtttcggcaacttcttcaatatctgccgtatcttcctgcggttcaaccaccggttctgcgtgttctgcaacttcctgggctacggcaacatcagactcggtaatcacctgcggctgttcagttaccgcggcagcaatcacttcaggatgcgtcgtttcaaccacttcaggttgcggttcggcaacctgaacgggggcttctacgacttcagccacttcttcaacaactggcgcgctaacaacaggtttgacagcggcggcgacagggacctcagtcaccatcggctgcacttgtacttcttcctgttcgtgctgctcttcaacctgtacatcttgcggacgtacaattggatagcggatccagactttgccagaggccagttccggagacgcgcacgctacggtcaacggcattggcgactgggttggataacgctcgtcacgatagcgacgacgacgctgaccacttacgcgcaggtgacgaggcgagcggcgagaacgacgcggcatgccaccgttgtcacggttatcggcattgttctcttcttgctgttctggtgcagcttgcgctacgactggcagcgggactttcaccagttctgtgcgtggagctggcgcttcctgaacaattggttcggcagcgacagtttcttcaaccaccggtgcgactaccgcttcttcggctacgctttgctcgtaacgcactttctgattgagctgacgctgtttacgacgcggctgaaccggacgtacacgttcttcctgttcggtttcctgaacagattgctcttcaacattcagcgccttcgcttcttgttgcgcctgacgtttatcatcgttacggcggcggctacgttcacgacgcggcgcttgctgctcgtcggtggtacgcgctttttccgttacctcagcctgctgacggctctcacgcgtctcgacagtctgctgctgtgcctggcgacgattacgacggttttcttcgcgattatcgctgccttctgtacgttcactacgggtatcgcggcgctcattacggtcacggcggttgttctgacgaggcttgcgacgatcctgttgacgttccggtttcgcttctgctttcggtgctggttgctcggccggtttggtttcttcaccaccgctgaacagcgctttcagtgcgccgaagaagcggctcaacaaccctggttgtgcaggagatgctggtgttgccgttgcagctttaggtgctggggctacaacaggcgcggcaggttcagctggggttggagctggcggcacatccggcatggcaaaggttgccagcgcaggttgttccggacgcttacgttcagcgaactcttcttcagacggcagcgccatcgcttcttcatgcagcttcggcagcatgtagcttaaggttggagtttcttcccctttacgcacgcgcagcacatggtagtgcggggtttccatctgatcgtttggcacaatcacacagcgcacgccgtcctgacgagtttcaatcgcattcactgcagaacgtttttcattcagcaggtaagacgcgattggcacaggaacaatggcgtgaacttcctgagtgttctctttcagcgcttcttcttcgatcagacgcagaatagagagcgacaacgattcgttgtcacgcacggtaccggtaccggagcagcgcgggcagacgtgatggctggattcacccagtgatgggctcagacgctgacgggacatttccagcaggccaaagcgagaaatatggctgatttgaatacgcgcacggtcctgacgcaccgcttcacgcagacgattttctaccgcacgctggtggcgtacaggcgtcatgtcgatgaagtcgataacaatcaggccgccgaggtcacgcaggcgcagctgacgagcaatctcatcggcagcttcgaggttagtgttaaacgcggtttcttcgatatcgccgccgcgggtcgcgcgtgcggagttgatgtcgatggccgttaacgcttcggtgctgtcgataacaatcgaaccaccggatggcagacgaacttcacgctggaaggcggactcgatctgcgactcgatctggtagtggctgaacagcgggatctcgccggtgtacagtttgattttgctgctgaaatccgggcggcctaatgcagcgatatgctgacgtgccagttcgagcactttcgggttatcgataaggatttcaccgatgtcctggcgtaagtaatcgcggaatgcgcgaacgattacgttgctctcctgatgaatcaggaacggagccgggcggctttcagcggcttttttgatggcttcccagtgtttcagacggaagcttaaatcccattgcagcgcctcagcagatttgccgacaccagcggtgcgcacgataagccccatgccttccggcagttcaaggcttgccagtgcttcttttaattcggtacggtcgtcgccttcgatacgacgagaaataccgcccgcgcgcgggttgttcggcatcagaaccagatagctacccgccagactgataaaggtggttaatgccgcgcctttgttgccgcgctcttctttatcgatctgaacaatgacttcctgaccttcacgcaacacatctttaatgttgggacgaccatgagcactgtagttagcagggaaatattcgcgggcaatttcttttagtgggaggaaaccgtgacgttcagcgccgtaatcaacaaaagcagcttccagactcggttcaatgcgggtgattttacctttgtagatgtttgcctttttctgctcgtgccctggactttcgatatccaggtcatacagacgctgcccatctacaagggcaacgcgcaactcttcctgctgagttgcgttgattaacattcttttcatcgtaacttactcattattcttacattgacgactaagctgcgggcaaagtaacgcctttccgggtgtgaaccgatggcctcgtgtctagtcgcgtcgccaacctcacggttatcgtcagctcaaagaggcgcagagtgtcggttgcccgtttttcatgcggaaaaacagcgcaattatcagagaaacagactgggtattactctccagaaatatttccatctaccggtaaggactgcaacccgcagcccgctaactgcctgaaagatcaatacgtcttacgccattgctgcgtggatgatcggtcgggcaaaatgggttattccgtaaaatttcttgttttaacaaggatggacacggaaacggcctcattattccactgcaagccttgttatagcaagatgacttttaccatttatcacccgcttactcacagttttttcacttcttgctggtgattggtttaataaccatcaataaagtgatcacctagtgaagtaataaggtgtaaaactaaatataagcatagaaaaatgagtggcgcgaatcctgttggctaattagaatcgcccaccatgaaaacagagactccatccgtaaaaattgttgctatcaccgctgacgaagcggggcaacgtatcgacaactttttgcgtacccaattgaaaggcgtaccaaaaagtatgatttaccgtattttgcgtaaaggcgaagtgcgggtgaacaaaaaacgtattaagcctgaatataaactcgaagcgggtgatgaggtgcgtatcccaccggttcgcgttgctgagcgggaagaagaggcggtttcgccacatctgcaaaaggtggcggcgctggcggacgtcatcttatatgaagatgatcatatcctggtgctgaataaaccttccggtacggcggtacatggcggcagtggtttaagcttcggcgttattgaaggtttgcgggcgttgcgcccggaagcgcggttccttgaactggttcatcgtcttgaccgggacacctcaggtgtgttgctggtagcgaaaaaacgctcggcgttgcgttctctgcatgagcaattacgtgaaaaagggatgcaaaaagattacctggcgctggtgcgcggtcagtggcagtcgcatgtgaagagcgttcaagcgccgttactgaaaaatattctgcaaagcggcgaacgtatcgtgcgtgtgagtcaggaaggcaaaccgtcggaaacacgctttaaagtggaagagcgctatgcatttgccaccctggtgcgttgtagcccggtaacagggcgtactcatcagatccgtgtgcatacacaatatgcgggtcatccgattgcctttgacgatcgctacggtgatggtgaatttgacagacagctcactgaagcaggcacgggattaaatcgcctgttcctgcacgccgcagcgttgaagtttactcatccggggaccggtgaggtgatgcgtattgaagcgccgatggatgaaggtttgaagcgttgtttgcaaaagctgcgtaacgcgcgctaatacaagcatataaatctgataatgggcggttggcctgataaggcgtttacgccacatcaggccgccagcaccgattgccggatgcgaagtaaccgcatccggcgcaaaaaactatcccatcagcgggtttttcccttcccgacgtaacatctgacacagcgcgattagcggtaaaccaaccagcgtgttaggatcacgcccctctaaacgctcaaacagcgtaatgccaaatccttcactcttaaagctacccgcgcagtgcaggggatgctctttacgcacgtaattatcaatctccgcctcgctcaggtgacggaaatggacgtcaaaaggctccacttctgtttgtagatgcccattcgccgaattaaacaacgccagtccagtatagaaggtgacgatattgccgctggctttgcgtaattgcagacgggcattttcttccgttaacggtttaccggtgatttcgccatcaagaacacatacctggtctgaaccaataattaaatgatccggataacgtgacgccagagattgcgctttttcttgtgccagtcgaagcaccaactgtcgcggtgattcgtcgctgcgtggagtttcgtcgacctcgggtgctgcacattcaaaagagatttgcagtttttccagaagagcgcgacgccagggcgaggtggaggctaaaataagtttaggcatatttttttccatcagatatagcgtattgatgatagccattttaaactatgcgcttcgttttgcaggttgatgttcgttatcagcactgaacgaaaataaagcagtaacccgcaatgtgtgcgaattattggcaaaaggcaaccacaggctgcctttttctttgactctatgacgttacaaagttaatatgcgcgccctatgcaaaaggtaaaattacccctgactctcgatccggttcgtacggctcaaaaacgccttgattaccagggtatctatactcctgatcaggttgagcgcgtcgccgaatccgtagtcagtgtggacagtgatgtggaatgctccatgtcgttcgctatcgataaccaacgtctcgcagtgttaaacggcgatgcgaaggtgacggtaacgctcgagtgtcagcgttgcgggaagccgtttactcatcaggtctacacaacgtattgttttagtcctgtgcgttcagacgaacaggctgaagcactgccggaagcgtatgaaccgattgaggttaacgaattcggtgaaatcgatctgcttgcaatggttgaagatgaaatcatcctcgccttgccggtagttccggtgcatgattctgaacactgtgaagtgtccgaagcggacatggtctttggtgaactgcctgaagaagcgcaaaagccaaacccatttgccgtattagccagcttaaagcgtaagtaattggtgctccccgttggatcggggataaaccgtaattgaggagtaaggtccatggccgtacaacagaataaaccaacccgttccaaacgtggcatgcgtcgttcccatgacgcgctgaccgcagtcaccagcctgtctgtagacaaaacttctggtgaaaaacacctgcgtcaccacatcactgccgacggttactaccgcggccgcaaggtcatcgctaagtaatcacgcgtctgcgtgatgaagcttagtgaggattttccccaggcaactggggaaagaccaaaccgggcggcgacgataccttgacacgtctaaccctggcgttagatgtcatgggaggggattttggcccttccgtgacagtgcctgcagcattgcaggcactgaattctaattcgcaactcactcttcttttagtcggcaatcccgacgccatcacgccattacttgctaaagctgactttgaacaacgttcgcgtctgcagattattcctgcgcagtcagttatcgccagtgatgcccggccttcgcaagctatccgcgccagtcgtgggagttcaatgcgcgtggccctggagctggtgaaagaaggtcgagcgcaagcctgtgtcagtgccggtaataccggggcgctgatggggctggcaaaattattactcaagcccctggaggggattgagcgtccggcgctggtgacggtattaccgcatcagcaaaagggcaaaacggtggtcctcgatttaggggccaacgtcgattgtgacagtacaatgttggtgcaatttgccattatgggctcagttctggctgaagaggtggtggaaattcctaatcctcgcgtggcgttgctcaatattggtgaagaagaagtaaagggtctcgacagtattcgggatgcctcagcggtgcttaaaacaatcccttctatcaattatatcggctatcttgaagccaatgagttgttaactggcaagacagatgtgctggtttgtgacggctttacaggaaatgtcacattaaagacgatggaaggtgttgtcaggatgttcctttctctgctgaaatctcagggtgaagggaaaaaacggtcgtggtggctactgttattaaagcgttggctacaaaagagcctgacgaggcgattcagtcacctcaaccccgaccagtataacggcgcctgtctgttaggattgcgcggcacggtgataaaaagtcatggtgcagccaatcagcgagcttttgcggtcgcgattgaacaggcagtgcaggcggtgcagcgacaagttcctcagcgaattgccgctcgcctggaatctgtatacccagctggttttgagctgctggacggtggcaaaagcggaactctgcggtagcaggacgctgccagcgaactcgcagtttgcaagtgacggtatataaccgaaaagtgactgagcgtacatgtatacgaagattattggtactggcagctatctgcccgaacaagtgcggacaaacgccgatttggaaaaaatggtggatacctctgacgagtggattgtcactcgtaccggtatccgcgaacgccacattgccgcgccaaacgaaaccgtttcaaccatgggctttgaagcggcgacacgcgcaattgagatggcgggtattgagaaagaccagattggcctgatcgttgtggcaacgacttctgcgacgcacgctttcccgagcgcagcttgtcagattcaaagcatgttgggcattaaaggttgcccggcatttgacgttgcagcagcctgcgcaggtttcacctatgcattaagcgtagccgatcaatacgtgaaatctggggcggtgaagtatgctctggtcgtcggttccgatgtactggcgcgcacctgcgatccaacagatcgtgggactattattatttttggcgatggcgcgggcgctgcggtgctggctgcctctgaagagccgggaatcatctccacccatctgcatgccgacggtagctatggtgaattgctgacgctgcctaatgctgaccgtgtgaatccagagaattcaattcatctgacgatggcgggcaacgaagtcttcaaggttgcggtaacggaactggcgcacatcgttgatgagacgctggcggcgaataatcttgaccgttctcaactggactggctggttccgcatcaggctaacctgcgtattatcagtgcaacggcgaaaaaactcggcatgtcgatggacaatgtcgtggtgacgctggatcgccacggtaatacctctgcggcctctgtcccgtgcgcgctggatgaagctgtacgtgacgggcgcattaagccgggacagttggttctgcttgaagcctttggcggtggattcacctggggctccgcgctggttcgtttctaggataaggattaaaacatgacgcaatttgcatttgtgttccctggacagggttctcaaaccgttggaatgctggctgatatggcggcgagctatccaattgtcgaagaaacgtttgcagaagcttctgcggcgctgggctacgatctgtgggcgctgacccagcaggggccagctgaagaactgaataaaacctggcaaactcagccagcgctgttgactgcatctgttgcgctgtatcgcgtatggcagcagcagggcggtaaagcaccggcaatgatggccggtcacagcctgggggaatactccgcgctggtttgcgctggtgtaattgatttcgctgatgcggtgcgtttggttgagatgcgcggcaagttcatgcaagaagccgtaccggaaggcacgggcgctatggcggcaatcatcggtctggatgatgcgtctattgcgaaagcgtgtgaagaagctgcagaaggtcaggtcgtttctccggtaaactttaactctccgggacaggtggttattgccggtcataaagaagcagttgagcgtgctggcgctgcctgtaaagctgcgggcgcaaaacgcgctctgccgttaccagtgagcgtaccgtctcactgtgcgctgatgaaaccagcagccgacaaactggcagtagaattagcgaaaatcacctttaacgcaccaacagttcctgttgtgaataacgttgatgtgaaatgcgaaaccaatggtgatgccatccgtgatgcactggtacgtcagttgtataacccggttcagtggacgaagtctgttgagtacatggcagcgcaaggcgtagaacatctctatgaagtcggcccgggcaaagtgcttactggcctgacgaaacgcattgtcgacactctgaccgcctcggcgctgaacgaaccttcagcgatggcagcggcgctcgagctttaaaagaggaaaatcatgaattttgaaggaaaaatcgcactggtaaccggtgcaagccgcggaattggccgcgcaattgctgaaacgctcgcagcccgtggcgcgaaagttattggcactgcgaccagtgaaaatggcgctcaggcgatcagtgattatttaggtgccaacggcaaaggtctgatgttgaatgtgaccgacccggcatctatcgaatctgttctggaaaaaattcgcgcagaatttggtgaagtggatatcctggtcaataatgccggtatcactcgtgataacctgttaatgcgaatgaaagatgaagagtggaacgatattatcgaaaccaacctttcatctgttttccgtctgtcaaaagcggtaatgcgcgctatgatgaaaaagcgtcatggtcgtattatcactatcggttctgtggttggtaccatgggaaatggcggtcaggccaactacgctgcggcgaaagcgggcttgatcggcttcagtaaatcactggcgcgcgaagttgcgtcacgcggtattactgtaaacgttgttgctccgggctttattgaaacggacatgacacgtgcgctgagcgatgaccagcgtgcgggtatcctggcgcaggttcctgcgggtcgcctcggcggcgcacaggaaatcgccaacgcggttgcattcctggcatccgacgaagcagcttacatcacgggtgaaactttgcatgtgaacggcgggatgtacatggtctgaccgcgatttgcacaaaatgctcatgttgcgcgcagtctgcgtggttatgagtaataattagtgcaaaatgatttgcgttattggggggtaaggcctcaaaataacgtaaaatcgtggtaagacctgccgggatttagttgcaaatttttcaacattttatacactacgaaaaccatcgcgaaagcgagttttgataggaaatttaagagtatgagcactatcgaagaacgcgttaagaaaattatcggcgaacagctgggcgttaagcaggaagaagttaccaacaatgcttctttcgttgaagacctgggcgcggattctcttgacaccgttgagctggtaatggctctggaagaagagtttgatactgagattccggacgaagaagctgagaaaatcaccaccgttcaggctgccattgattacatcaacggccaccaggcgtaagtgaacatctccaggcggtcgttcgaccgcctgagttttatcttttgtcccactagaatcattttttccctccctggaggacaaacgtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccaagcatctctatcgcgaccgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgcgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaagttgtcattttccacccttataaaaggtccgcttgcgggccttttttcttagcttttattccgacttgttccgtagtgaacatgctgccacactaacaattctctgataaggagccggtatgttcttaattaacggtcataagcaggaatcgctggcagtaagcgatcgggcaacgcagtttggtgatggttgttttaccaccgccagagttatcgacggtaaagtcagtttgttatcggcgcatatccagcgactacaggatgcttgtcagcggttgatgatttcctgtgacttctggcctcagcttgaacaagagatgaaaacgctggcagcagaacagcaaaatggtgtactgaaagtcgtgatcagtcgcggtagtggcgggcgagggtacagcacattgaacagtggaccggcaacgcggattctctccgttacggcttatcctgcacattacgaccgtttgcgtaacgaagggatgacgttggcgctaagcccggtgcggctggggcgcaatcctcatcttgcaggtattaaacatcttaatcggcttgagcaagtattgatccgctctcatcttgagcagacaaacgctgatgaggcgctggtccttgacagcgaagggtgggttacggaatgctgtgcggctaatttgttctggcggaagggcaacgtagtttatacgccgcgactggatcaggcaggtgttaacggcattatgcgacaattctgtatccgtttgctggcacaatcctcttatcagcttgtcgaagtgcaagcctctctggaagaggcgttgcaggcagatgagatggttatttgtaatgcgttaatgccagtgatgcccgtacgtgcctgtggcgatgtctccttttcgtcagcaacgttatatgaatatttagccccactttgtgagcgcccgaattagtcatgaaaaaagtgttattgataatcttgttattgctggtggtactgggtatcgccgctggtgtgggcgtctggaaggttcgccatcttgccgacagcaaattgcttatcaaagaagagacgatatttacccttaagccagggaccggacgtctggcgctaggtgaacagctttatgccgataagatcatcaatcgcccacgggtttttcaatggttgctgcgtatcgaaccggatctttctcactttaaagccgggacttaccgctttacaccgcagatgaccgtgcgcgagatgctgaaattgttggaaagcggtaaagaagcacagttcccgctgcgactggtagaagggatgcgtctgagcgactacctcaagcaattgcgtgaggctccgtatatcaagcacacgctgagcgacgataagtacgccaccgtagcgcaggcacttgaactggaaaacccggagtggattgaaggttggttctggccagacacctggatgtataccgccaataccaccgatgtcgcgttactcaagcgagcgcacaagaaaatggtgaaagcggtcgatagcgcctgggaagggcgtgcggacggtctgccttataaagataaaaaccagttggtgacgatggcatcaattatcgaaaaagaaaccgccgttgccagtgaacgcgatcaggttgcctcagtatttatcaaccgtttacgcattggtatgcgcctgcagaccgacccgaccgtgatttacgggatgggagagcgttataatggaaaactttcgcgtgcagacctggaaacgccgacagcgtataacacctataccattaccggtctgccgccaggtgcgatagcgacgccgggggcggattcgctgaaggctgctgcgcatccggcaaaaacgccgtatctctattttgtggccgatggtaaaggtggtcacacgtttaataccaatcttgccagtcataacaagtctgtgcaggattatctgaaagtgcttaaggaaaaaaatgcgcagtaagtatatcgtcattgaggggctggaaggcgcaggcaaaactaccgcgcgtaacgtggtggttgagacgctcgagcaactgggtatccgcgacatggttttcactcgggaacctggcggtacgcaacttgccgaaaagttaagaagcctggtgctggatatcaaatcggtaggcgatgaagtcattaccgataaagccgaagttctgatgttttatgccgcgcgcgttcaactggtagaaacggtcatcaaacctgcgctggctaacggcacctgggtgattggcgatcgccacgatctctccactcaagcctatcagggtggaggacgaggtattgaccaacatatgctggcaacactgcgtgatgctgttctcggggattttcgccctgacttaacgctttatcttgatgtcaccccagaggtcggcttaaaacgtgctcgcgcccgtggtgagctggatcgtattgagcaagagtcattcgatttctttaatcgcacccgcgcccgctatctggaactggcagcacaagataaaagcattcataccattgatgccacccagccgctggaggccgtgatgggtgcaatccgcactaccgtgaccaattgggtgaaggagttggacgcatgagatggtatccatggttacgacctgatttcgaaaaactggtagccagctatcaggccggaagaggtcaccatgcgctactcattcaggcgttaccgggcatgggcgatgatgctttaatctacgccctgagccgttatttactctgccaacaaccgcagggccacaaaagttgcggtcactgtcgtggatgtcagttgatgcaggctggcacacatcccgattactacaccctggctcccgaaaaagggaaaaatgcgctgggcattgatgcggtacgtgaggtcaccgaaaagctgaatgagcacgcacgcttaggtggtgcgaaagttgtctgggtaaccgatgctgccttactaaccgacgccgcggctaacgcattgctgaaaacgcttgaagagccaccagcagagacgtggtttttccttgctacccgcgagccagaacgtttactggcaacattacgtagtcgttgtcggttacattaccttgcgccgccgccggaacagtacgccgtgacctggctttcacgcgaagtgacaatgtcacaggatgcactacttgccgcattgcgcttaagcgccggttcgcctggggcggtactggcgttgtttcagggagataactggcaggctcgtgaaacattgtgtcaggcgctggcatatagcgtgcaatcgggcgactggtattcgctgctagcggcccttaatcatgaacaagctccggcacgtttacactggctggcaacgttgctgatggatgcgctaaaacgccatcatggcgctgcgcaggtgaccaatgttgatgtgccgggcctggtcgtcgaactggcaaaccatctttctccctcgcgcctgcaggctatactgggggatgtttgccacattcgtgaacagttaatgtctgtcacaggcatcaaccgcgagcttctcatcaccgatcttttactgcgtattgagcattacctgcaaccgggcgttgtgctaccggttcctcatctttaagagagacatcatgtttttagtcgactcacactgccatctcgatggtctggattatgaatctttgcataaggacgtggatgacgttctggcgaaagccgccgcacgcgatgtgaaattttgtctggcagtcgccacaacattaccgggttatttacacatgcgggatctggtaggcgaacgcgacaacgtcgtattttcttgtggcgtgcacccactcaaccagaatgatccctacgatgtagaagatttacgtcgtctggcggcagaagagggcgttgtagcgctgggtgaaaccgggctggattattattacacgccggaaactaaagtacgtcagcaagagtccttcatccatcatatccagattggtcgtgaactgaacaagccggttatcgtccacacccgtgacgcccgcgccgatacgctggcaattctgcgcgaagaaaaagtgacggattgcggtggcgtactacactgttttacagaggacagagaaacggcgggtaaattactggatctcggattttacatctccttttccggcattgtgaccttccgtaatgcggagcaactgcgcgatgctgcgcgttatgtccccctggatcggttactggtggaaactgactcaccttaccttgcgccagtaccgcatcgaggaaaagagaatcaacctgcgatggttcgtgacgttgcagaatacatggctgtgttgaaaggtgttgccgttgaagaactggcgcaggtaaccaccgataacttcgcccgtctgtttcacatcgacgcttcccgccttcaatcaatccgttgaatgagtttttttaaagctcgtaattaatggctaaaacgagtaaagttcaccgccgaaaatcgggcggtgaataaccacgtttgaaatattgtgacatatgttttgtcaaaatgtgcaacttctccaatgatctgaagttgaaacgtgatagccgtcaaacaaatcggcactgaattattttactctgtgtaataaataaagggcgcttagatgccctgtacacggcgaggcactccccccttgccacgcgtgagaacgtaaaaaaagcacccatactcaggagcactctcaattatgtttaagaatgcatttgctaacctgcaaaaggtcggtaaatcgctgatgctgccggtatccgtactgcctatcgcaggtattctgctgggcgtcggttccgcgaatttcagctggctgcccgccgttgtatcgcatgttatggcagaagcaggcggttccgtctttgcaaacatgccactgatttttgcgatcggtgtcgccctcggctttaccaataacgatggcgtatccgcgctggccgcagttgttgcctatggcatcatggttaaaaccatggccgtggttgcgccactggtactgcatttacctgctgaagaaatcgcctctaaacacctggcggatactggcgtactcggggggattatctccggtgcgatcgcagcgtacatgtttaaccgtttctaccgtattaagctgcctgagtatcttggcttctttgccggtaaacgctttgtgccgatcatttcaggcctggctgccatctttactggcgttgtgctgtccttcatttggccgccgattggttctgcaatccagaccttctctcagtgggctgcttaccagaacccggtagttgcgtttggcatttacggtttcatcgaacgttgcctggtaccgtttggtctgcaccacatctggaacgtacctttccagatgcagattggtgaatacaccaacgcagcaggtcaggttttccacggcgacattccgcgttatatggcgggtgacccgactgcgggtaaactgtctggtggcttcctgttcaaaatgtacggtctgccagctgccgcaattgctatctggcactctgctaaaccagaaaaccgcgcgaaagtgggcggtattatgatctccgcggcgctgacctcgttcctgaccggtatcaccgagccgatcgagttctccttcatgttcgttgcgccgatcctgtacatcatccacgcgattctggcaggcctggcattcccaatctgtattcttctggggatgcgtgacggtacgtcgttctcgcacggtctgatcgacttcatcgttctgtctggtaacagcagcaaactgtggctgttcccgatcgtcggtatcggttatgccattgtttactacaccatcttccgcgtgctgattaaagcactggatctgaaaacgccgggtcgtgaagacgcgactgaagatgcaaaagcgacaggtaccagcgaaatggcaccggctctggttgctgcatttggtggtaaagaaaacattactaacctcgacgcatgtattacccgtctgcgcgtcagcgttgctgatgtgtctaaagtggatcaggctggcctgaagaaactgggcgcagcgggcgtagtggttgctggttctggtgttcaggcgattttcggtactaaatccgataacctgaaaaccgagatggatgagtacatccgtaaccactaatccgtaagacgttggggagactaaggcagccagatggctgccttttttacaggtgttattcagaattgatacgtgccggtaatgctgaaattacgcggtgcgccgtagacgatagaaccttccacgttggtatcgtaggttttgtcgaacaggttattgacgttcccctgcaacgagaagtttttcgtcacctggtagcgggtgaagagatccaccagcgcgtagctgccttgctcggcgcggaaggtgccatacggcgtcacggtgtcggtatacacgcgattttgccagttaacaccaccgccgaccgtcaactctggcatgacaggcaaccgatagctggtgaacattttaaccgtggtgcgtggcagattaggattaacggcgtttccttcgttatcctctgcaatatagcgcgttgcgccaaacgtcagctgccagttgtcggtaattgcgccgttgagttcaaattccacacctttactgactgtcccatccaccgctttataggcggtttcgccgttgctgccggggataggtgtaccggtggactgagcgacattatcctgctcaatacggaagatggctaacgtggtggtcagacggctattcatccagtccgatttcagacccagctcgtagttgttaccggtgattggagtcagatatttgcctgaactgtcacgatcattttgcggctggaaaatagaggtatagctggcgtaggtcgaccagttgtcattgatgtcaaacaccagaccagcgtaaggcgtggtgtggtttttctccatgctgtaagtcagcgtatcaacccgccagttggtataacgtgcgccgaggatcagatgcagcggatcggcaagggtgacacgagtggcagcatataacgatttcatatgtgtggtatcgtcctgcgccaggctctgtggtgaccagtcggtttgtgggaaattgccattaaagttgtagaaactgccaatttcatccgggaagatgttggcccatgaactgaagtaacgattgttttgtttgctgtaactgccaccaaacattagattgtgctgacgaccaaacaattcataactaccgtcagcgaacaaatccagcgcatcaactttacgtttgccgctgttccaaccggtgccgccgacataatcaaaaccaggtccataattactgtatggcccaaccagcataccatccgctttgtttacataggcatcgacatacatcattttgctgtcaaattcgacttcagagtgggtggcattcagcgtcgcttgccaggtatcagcaaaccgctgcttcagggtcataaagaccttgttgatctctttatcgttgtacgcccagtcaggtgcggtactgcgtgcgcgatcgtaactgttgctgctgccatcagtattccagcgcggtaaaccaccccaggttgggctattaacatcaatacgctgatattcgtaaccggctgaaagcatcgtaagatcgcctaaatcagcatcgacaatgccggagaagaaggccttttcactgttgtagcggtccagccatgagtcgttattctggtagccgccgacaattcgtgcgcggattttaccatcttcggtgagtgggctttgtaaatccgccacataccgttctttgttccagctaccgtattccgccgagacatcgcctttaaattcacgactggtcgcgtgttttcgaaccatattaattgccgcagatggattacccgtcccggtcatgaggcctgtcgcgccacgcactacttctacgcgttcaaacagtgccatatcagaaagtgcgtcgcccagattccagcgcgattcaaaataggtggggataccatcaaccatatagttatcgatctggaatccgcgggaataataaagagcacgatcggaatccgcctgacttttgctgatccccagcgtgttttccatcacttcgcccagcgtttgtaactgctgatcttccatccgctgctggctaacaatagtgaccgactgaggaatatcacgttgagtcatctgcatttttgtacccgcagaggtagacgttacgttgtaatcattttcgccatcatctggggctgtggctgaaccctcaacaatcaccgtttcttcagtgactggtgcagcaaaagcggcggaaggtaatagtgccagtgctatgcaaccggcaaggagtgacggtttgatgatagcttgatgttgattatccctgttaaattgtgtcgaaagcatttgaaatctcttggtttatgttggcgtcaggctcatgccggagcagggtgatgagcggttatatttagtgtgcgaataattttgtatgtaaatgcaaatgagagatatacgcattcatatttagtgtgtaaaccaaacagagaatgtcttttcagcgcattcgcaggcagaaatgggaataatggcgatatatacggcagcaaaacgattttttgcttaagaaatcgtgagttaaggttgaaagagcaggtttaactcgaccatactctatactcgcagtgtggcgcggcgtagcatggcgcaacgcatggctatttgaaaaaggaaaatgtcgtggcagaagaaactatattcagcaaaattattcgtcgtgagatcccctccgatatcgtctaccaggatgatctggtaacggcgtttcgcgatatttcgccgcaagcgccaacgcatattctgatcattccgaatatcctcattccgactgtgaacgacgtgtcagctgagcatgagcaggcgctgggacgcatgatcaccgtagcggcaaaaattgctgagcaagaaggtattgccgaagatggctatcgtctgatcatgaacaccaaccgccatggcggacaagaggtttaccacatccatatgcatttgttgggtggctgtccgctgggaccaatgctggcgcataaaggtctgtaacgatgagaaaaggatgctttgggctgatgtctctggcgttgttagtgctggtgggctgtcgttcacatccggaaattccggtgaatgatgagcaatcgctggtgatggagtcatctttattagctgcgggcatcagtgcagaaaagcccgtcctttcgacatctgatattcaaccttcagcatcctcaacgctttataacgaaaggcaagaacccgttaccgttcattatcgtttttactggtatgacgccagagggctggagatgcatcctctggaaaggccacgcagcgttaccattcccgcacattcggcggtcacgctgtacggcagcgccaattttctgggggcgcacaaagtcagactttatctatatttgtaaggggtgaatcttgatgacaaaaatgagtcgctacgccttgattaccgcgctggcgatgtttcttgccgggtgtgtggggcaacgtgaacctgcaccggtagaagaagtgaaaccagcgccggaacaacctgctgagccacaacagcctgtccccacagtgccatcggtgccgacgataccgcagcagccaggcccaattgagcacgaagatcaaactgcaccgcctgcgccgcatattcgccattatgactggaatggcgcaatgcagccgatggtcagtaagatgcttggggctgacggcgtgactgcgggtagcgtcctgctggttgatagcgttaacaaccgtactaatggttcgttgaatgccgcagaagcgaccgaaacgctgcgaaatgcgctggctaataacggtaaatttaccctagtttccgcccagcagctgtcgatggctaagcaacaattaggtttgtcgccgcaggacagtttaggcacccgtagtaaagccataggcattgcccgcaatgttggcgctcattacgtgctgtactccagcgcctctggcaacgttaacgctccgaccctacaaatgcagctgatgctggtgcagacgggcgaaattatctggtcaggtaaaggtgccgtttcgcagcaataatcccctcacgcgcgacgaattgctgtcgcgctttttcccgcagtttcatcccgtcacgacgtttaatagtgggcttagtggcgggagttttctcattgaacatcagggccagcgttttgttgtgcgtcagccgcacgatcctgatgcgccgcagtccgcgttcttgcgccagtatcgggctttatcacaactacccgcatgcattgcaccgaagccgcatttatatctccgtgactggatggtggtcgactatctgcccggcgaggtaaaaacgtatttgccggataccaacgaactggcaggcttgctgtattatctacatcaacaaccgcgttttggctggcgaataacgctgttgccgttactggaactgtactggcagcaaagcgatccggcgcggcggacagtgggttggctgcgaatgttaaaacgtctgcgcaaagcgcgggaaccacggcttttacgcttaagtccattgcatatggatgtccacgccggaaatttagtgcatagcgcgccagggttaaaactcatcgactgggagtatgccggagatggtgatatcgcgctggaactggcggcggtgtgggtggaaaatactgaccagcatcggcaattggtcaatgactatgccactcgcgcgaagatttatccggcgcaattatggcgtcaggtcaggcgatggtttccctggctgctgatgctcaaagcagggtggtttgagtaccgctggcgacaaaccggcgatcaacaatttatcaggctggccgatgacacctggcggcagctattaataaaacaataaggagagcagtgtgggtccagtaatgttggatgtcgaaggttacgaactggacgcggaagagcgtgaaatactggcgcatccgctggtgggagggctgattctctttacgcgaaactatcatgatcctgcccagttacgtgaactggtgcgccagatccgcgcagcatcgcgcaatcatctggtggtggcggtagatcaggaaggtggacgcgtgcagcgttttcgtgaaggttttacccgcttgccagcggcacaatcattcgctgcgctgttgggaatggaagaaggcggaaaactggcgcaagaggcaggttggttgatggccagcgaaatgattgctatggatattgatatcagctttgcgccagtgctggacgtcgggcatatcagcgcggcgattggcgagcgttcttatcatgccgatccacaaaaagccctggcaattgccagccggtttattgatggtatgcatgaagccggaatgaaaactaccgggaaacacttcccaggtcacggtgcagtaacggcagactcacacaaagaaacaccgtgcgacccacgtccgcaagcggagattcgcgctaaagatatgtcggtcttcagttccttaatccgcgaaaataaactcgacgccattatgcctgcgcatgtgatctacagtgatgttgatccgcgtccggcgagcggttctccctactggctgaaaaccgttttgcgtcaggaattgggttttgacggcgtgattttctctgacgatttatcgatggaaggcgcagcgattatgggcagttatgccgagcgtggacaggcatcactggatgcaggttgcgatatgatcctggtctgcaataatcgtaaaggggccgtcagcgtgttagataatctgtcaccgatcaaggcagaacgtgttacacgtttgtatcataaaggttcattttcgcgacaggaactgatggactcggctcgctggaaagcgatcagcgcccgtctgaatcagttacatgaacgctggcaggaagagaaggcaggtcattaaccctggcttatgtgaggaagcgatgattatctatttgcacggttttgactctaacagtccgggtaaccacgagaaagtcttacaattgcagtttattgacccggatgtacggctaataagctacagtacgcggcatccgaaacatgatatgcagcatttgctcaaagaagtggacaaaatgttgcaactgaacgtcgacgagcgtccgctcatttgtggtgttggtctgggcggttattgggctgagcggattggttttctctgtgatatccgccaggtgatcttcaaccccaatttgttcccttatgagaacatggaagggaagattgatcgcccggaagagtatgccgatattgccactaagtgtgtgaccaacttccgtgagaagaatcgcgatcgttgcctggtgattttgtcgcgtaatgatgaagcgcttaacagccagcggacatctgaagagttgcatcattattacgagattgtctgggacgaagagcagacgcacaaattcaagaatatctccccgcatttacagcgcattaaagcgttcaaaaccctcgggtaaatgccctcgtcgcatcaggtaaccttgccggtacctgatgcgctccggattctgtgggttggataaggcgttccgccgcatccgacagtcgagcatcaatgcctgatgcgcctcttatcaggcctaccgaacgccctccatacacacctcactctatatcattctcacaaatcagctcaaataataaacaataaactctgttttttgatctcacccggtaaagtcgcctatcttttcagcaacaaaacttgattaacatcaattttggtatgaccaatgcaccattcatgttattctcaatagcgaagaacattttcattgctgtaacctgttgttaattaagagctatgctaataaccattaattaacaattggttaataaatttaagggggtcacgttgactacgccattgaaaaaaattgtgattgtcggcggcggtgctggtgggctggaaatggcaacacagctggggcataagctgggacgcaagaaaaaagccaaaattacgctggtcgatcgtaaccacagccacctgtggaaaccgctgctgcacgaagtggcgactggctcgcttgatgaaggcgtcgatgcgttgagctatctggcccatgcgcgcaatcatggtttccagttccagctgggttccgtaattgatattgatcgtgaagcgaaaacaatcactattgcagaactgcgcgacgagaaaggtgaactgctggttccggaacgtaaaatcgcctatgacaccctggtaatggcgctgggtagcacctctaacgatttcaatacaccaggtgtcaaagagaactgcattttcctcgataacccgcaccaggcgcgtcgcttccaccaggagatgctgaatctgttcctgaaatactccgccaacctgggcgcgaatggcaaagtaaacattgcgattgtcggcggcggcgcgacgggtgtagaactctccgctgaattgcacaacgcggtcaagcaactgcacagttacggttataaaggtctgaccaacgaagccctgaacgtaacgctggtagaagcgggcgaacgtattttgcctgcattgccgccacgtatctctgctgcggcccatagtgagttaacgaaactaggcgttcgcgtgctgacgcaaaccatggtcaccagtgctgatgaaggcggcctgcacactaaagatggcgaatatattgaggctgatctgatggtgtgggcagccgggatcaaagcgccagacttcctgaaagatatcggtggtcttgaaaccaaccgtatcaaccagctggtggtggaaccgacgctgcaaaccactcgcgatccagacatatacgctattggcgactgcgcgtcatgcccgcgtccggaagggggctttgttccgccgcgcgctcaggccgcacatcagatggcaacctgcgcaatgaacaacattctggcgcagatgaacggtaagccgctgaaaaattatcagtataaagatcacggttcgctggtatcgctgtcgaacttttccaccgtcggtagcctgatgggtaacctgacacgcggctcaatgatgattgaaggacgaattgcgcgctttgtatacatctcgctgtaccgaatgcaccagattgcgctgcatggttactttaaaaccggattaatgatgctggtggggagtattaaccgcgttatccgtccacgtttgaagttgcattaatcggcttgtactggcggatgcggcgtaaacgccttatccgccctggacaaatggtacgagcggtaggcctgataagacgcgttaagcgtcgcatcaggcattccttcagactcctccgaatccctaagtatttccagccattcccgcgcttttcatcttctgtctgatagctgcttttctccttcgcttgcatgattggcataacagcaaagaaggaggtattcccgtgaataagtcaatgttggcgggtatcgggattggtgtcgcagctgcgctgggcgtagcggcagtggccagtctgaacgtgtttgaacgtggcccgcaatacgctcaggttgtttctgcaaccccaatcaaggaaacggttaaaacaccgcgtcaggagtgtcgcaacgttacagtgacccatcgtcgaccggtgcaggatgaaaatcgcattaccgggtcggtgctcggcgctgttgctggcggcgtgattgggcatcagtttggtggtggtcgcggtaaagatgtcgccactgttgtgggggcgctggggggtggatatgcaggtaaccagatccagggctctctccaggaaagcgatacttacacgactacgcaacagcgttgtaaaacggtgtatgacaagtcagaaaaaatgctcggttatgatgtgacctataagattggcgatcagcagggcaaaatccgaatggaccgcgatccgggtacgcagatcccgctagatagcaacgggcagctgattttgaataacaaagcataacaaggttgtactctgcaatttagcccctcattcgctcaagctgaggggctttttttgcaacctatttcagcagttccggccataaacgcaaagtcgttcgggcaatctgcatcagtttttccagcgatgcaccttcgcgtgcgctgatcgacatcccctgaataatacaattaaggaattctgccagatgcgtcacgtcacagtgggtcgggatttccccgcgcgcttgtcgttgacataaaaactgctgcaaagtgcgctcttgcatcgcatggcgtgatttcagcgtattggcgatatctcctgaatccggggagagggtggtgcagttgttgatcatgaagcagccagccggagtgtctttgctggtaaagcagttggcgatggcagcaaaatagtcagccagcgcagactccacgcttttctcttcacaaaacagctgtgcttcatgcttggcggcaaaacgatcgatatagcggtcgagtacggcgcggaataacccctctttgttggtaaattccgcgtatagcgtgggcgctttagctccggtcgcttcaacgaggtccgcaagagaagtcgcttcataaccgtgctgccagaacaatttcatggccttatcaagcgcggcatccctgtcgaacacttttgggcggccacggcttttttttacacattgtgttgagtcagttgccatgatgccgttgtacctggtgactgtgaatgaaaggttattataaaaataatcacctccgttcaccagtccagaaaccataaaaataatcgctttatatttaactgaaatttaaaggtttttaaattaattaatgattgttataaaaaatatcttgtatgtgatccagatcacatctatcatttagttatcgatcgttaagtaattgcttgcgacgtcattcatctgcataaggccactattatgaaaaacgtaaaaaacctcatcgctgcggcgattttaagctccatgtcatttgccagctttgcggctgtcgaagttcagtccacgccagaaggccaacaaaaagtcggtactatcagtgctaacgcggggacaaatctgggatcgctggaagagcagttggcgcaaaaagcggatgagatgggcgcaaaatctttccgtattacttctgtaaccggtccgaataccctccatggaacagcagtaatttataaataagcattaaccctcattaatgcctgctactgcttgtttttttccccgcgacatgccgtgtcgcggggatttttttatccgagctttacagagtttgtgggctcacttgatgacggcggacatccaccggcatcccggaacggacatccatcacatgttgcatcaattcagcgtcagtttgtgctgcatctttaaatgattgcattgcgctattcagtgtaattggcagcagctgcggatcgtcatcaatcttctctgacagcggctgatgtacttcaaccagacgcgcaccgtttggttcggcagagactttaatcggggtgttgatgatattcactttggtgcctggggtgacctggctaaagagtgttttgatatcgtcatcccgcagacgaatacagccagaacttacccgcatgccaatgccgaaatcagcgttcgtaccgtgaagcaaataaacgccgccataggccgccagacgaatcgcatgatggcccattgggttatccggtccagccggaactaccgcaggcaactcaattccctgtgccttataccgcgcgcgaatgtttgccgttggcgtccaggttgggtttgcacgcttgtcagaaacagtggtcaccattgtcggtgtcagcgtgtcaccacctaactgaccaatgccgatgggatatacggttaccgaattttttcccggcggataataatagagacgcagctccgcaatgttgatcacaatgccttcgcgcggcgcgtctggaagtagggtttgcaacgggatcgttaacacgctacccgcgcgcggtacgtaaggatcaacgccggggttagcctgtaacagagcgagaaagccgacgttatattttttggcgatcgcttccagagaaccaccgtcattttccaccacatgaaatttgttttcaccaaccagacgactgtccgctgacggcagcggccaggtgttggcttttgccggtagcgccagcgccacggcagcggcgaacgtaaaaaacgttagccagcgagaaaaacgcgttttgatcatcaccaaagtccataataaatataaggttattgtaataaaaaagtaagtctgaattatggagggtgacagtgtcggataatgcagggaagtgcaaagaatttgtaaatattgcagatgggggcgcagagacgcccccgatttaccatcaagcgatcgcgttctcttccagttcacgcataaactggcgtacccattcgatacgcgttttccgctcgctcaaatcctgaataaacttcagacgcgtcggaccatcaaggcggtaatgctgcggctgtttttgcagcaaaccaatcaaccaggctggattaacgtgattcttctcggcaaattcgatcacgccgcctttctcattaccttccagcttcctgatccccagtttctgcgcttgctggcgcagacgggcaatatccagcagggtacgcgccggatccggcagcaggccgaagcgatcgataagctcgactttgatctcttccagttcgttttccgttttggcgctggcaatacgtttgtagaacgacagacgcgtgttcacgtcagggatgaaatcatctggcaatagcgacggcatccgcaggtcgacttctgtttgctggctggtgagatcttccagcgacggctcgcgtccggctttcagcgcatcgacggcgttttccagcaactccatatacagcgagaaaccgatggtttccattgagccgctttgttcttcgccaagcagttcacctgcgccgcggatctccagatcgtgcgttgccagcgcaaaacctgcaccgagatcttccagcgaggcaatcgcttcaagacgtttttgcgcatcggtagtcatcgcttttggatgcggcgtcagtagccatgcatatgcctggtggtgagaacgcccgacgcgaccgcgcaactggtgcaactgtgccagaccgaagtgatccgcgcgttcaatgataatggtgttggcggtaggaatgtcgatcccggtttcgataatggtggtacaaaccagcacgttgaaacgttgatgatggaaatcattcatcacccgttccagttcgcgctcacgcatttgcccgtgaccgatggcaatccgcgcttcaggtaccagttctgccagccgttcggcggctttctggatgttttccacatcattgtagagataataaacctgtcctccgcgcaaaatttcacgcaggatcgcctcccggaccaccagactgtcatactcacggacaaaggttttaactgccagacgacgggcgggcggcgtggcgataatcgacagatcgcgcattccgctcattgccatattcagcgtacgtgggatcggcgttgcggtaagcgtcagaatatccacgttcgcgcgcatcgctttaatgcgctctttatgacgcaccccgaagcggtgttcttcatcgacaatcagcaggcctaaatctttaaacttgacgtcactttgcagcagtttgtgcgtaccgatcagaatatcgattttcccttccgccacttccgcaaggatttgcgtctgctctttggcgctgcggaaacgggagatcatttcgatacgtaccggccagttggcgaaacggtcgcggaagttgtcgtaatgctgctgcgcgagaagggtggtaggcaccagcaccgccacctgtttgtggttatctaccgccaggaaagcggcgcgcatcgccacttctgttttaccaaagccaacatcgccgcacaccagacgatccattgccagcggctgacacatgtcgctaagcaccgcattaatggcttgagcctgatccggcgtggtttcaaacgggaagctgtcgcagaataactgatactgctcacgatcgtgtttaaacgcgaagccctctttggcggcgcgttgcgcgtagatatccagcaattccgccgccacatcacgcactttttccgccgctttctgccgtgcgcgtgaccaggcatcgccaccaagtttatgcagtggtgcgttttcttctgcgccacccgcgtaacggctaatcagatgcagtgacgacaccggaacatacagtttggcgtcgttggcataggtgagcatcaaatactcgccagtaatgcctccagcttcgagcgtggtcattccggcataacgaccgacgccgtgctccagatggaccaccggctgaccaatatgcagctccgcaaggttacggatcagtgtatcggggttgatggcgcggcgagaatcctgacgacgacgggcaacgcgttcaccgagcagatcgctttcgcaaatcagcgccaggttacgcatcgtatcgacaaaaccatgttcggcagcgccaatcatcagataacgcccacggtcgctggcttcatcaagacgcataatgcgttgcggagcaattttaattcgcgcgagcagttcacccagcgcttcacggcgaccttcactttctaccgagaacaccaccggaccgtcgaaagtctcgaggaacttacgcagcgcatccagcggcgctttttgttgtgcctgaatggccaggtctggcagtttctggaaacctaaattggcattcgcggcttttgtcggtaaatgttcagtttttagctgcacacgcggccagtttttcagctctgaaaagagctcgtctacccgtagccagatcgattgtggtggcaacagtgggcgcattgggtcgacaccgcgattctcaaaacgcgcgagcgtgtcagcctggaaacgttcggcactgttttccagatcgccagtatttatcagcagcgtattggcagggaaataactgaacagtggcggcagcggttcgctgaagaatagcggctgccagtactcgatcccggcaggtaatgtgcctttactcacttgctggtaaatatgttccggatcgcgcttcacttcgaaggtatcgcgccactggctgcggaacagttcaattgccgctttatcagtcggaaattcgtgcgcgggcagcagattgatcgcttctacttcctccagcgtgcgctggctatcgacgtcaaacacccgcaggctgtcgatttcatcatcaaagaaatcaagacgataaggcagctcactccccatcgggaagagatccagcaacgcgccgcgagtggcgtattcgccgtgctccatcacctggtcaacatggcgataaccggcgctgtccagttgggttcgtaatgcatctcgtgacaggcgctgaccttttttcatcgccagcgcatgaccgtggagaaagctgtgcgggcaaacgcgctgcataagcgtattcaccggaacaatcagtacgccacgctgcatggtcggtagctggtaaagggtggaaagacgcgaggagataatgtcctgatgaggcgaaaaactgtcgtaagggagggtttcccagtccgccagattcatcaccatctgatcggtgaactggctgatttcatcatgcaaacgcagagcattttgcatatctggtgcaatgagtaccaccggaccggcgtgacgttcggcaatttccgctaccagcgtcgcgcaggcagcgccggttaactcgcccagcagacgctgctcacccgctttgacgggcagcgtataacgatattgttcaggcataacggttgtcagattctcgttaggatatgcctcaacatatgagggcatatctctgataagcaatgctgttcattatccgtaatcggcatggtttagcaaattgaatcgccccggctggggcgatggcttagcgggagtaactgacggtagcgggcagagaaggcggggagaacaacagatcgctgaatgcgcgctgtgaaagttttcttaccagcaagcccgcaacagtacaaatcaacaaactgacaaaggggtaaatcagcaggagcgtcagttcgacttgcggcgaccagcgtaccgcgttcatttgcggaatcaggcttaagctgaatatttctaccagaatgcgatgggtggtatagatagcaatggtgttggagccaatcacattcagcaggctggaggaacgcataccgaaacgctgttcgtactgataaaacagcttcatgattaccacaatcgataccagcgacaacagcagcgagatattaaacaaccaggcaccgaccgccagaacggtcagcaaagaagccatcagcagatggcggcgcaacggtaccgctttaacacaggtcattaatgttgcgccaaaccatgcgccaaggctgtaataaggcaaattgcggatcacactgttcattccccaccacggtgtgggtacgaaattaacagccacactcatcagtacaaacagaacaaataacggcagggccaggcggttaaaaattttacatatcacgaaatagacaattaacgcatacagataccacaagctggtgctggcggtgatcatcccgtgcaggaactcaccggtggaatcggcataagcggcattggaggcattgcttaaattgcgctcaggtgccagccactgatttagtgcacttagcgccagccactgcaccacgccccaaagcgccagcacccagaagatgttccagatgcgtttatcgagacaatttccccacggtacgctgtcgatatagcggcgaatcaaatagccagagataaagaaaaaaaccggcatacgaaagggtgcaaggtaaagattgaaatagatccagcatttgctcaggacttccgataacggatgctgaaaagtggtcagatgcggataaaaggtaatgaccgagtgataaatcactaccagacaaatacataaccctttgatctggttaatccatagctctttttgtttcatcaggacaacacgctctttttatttaacatgctgttaatcctgcggggcgagttgcgtggtgtaatgcgtatctgtctgtatttggttatttttcagataaagatcagcccacaaggccgatgagaaaatgaggccctttagccgattgatttacgggggcttttcagattagccctgacgatcacttacagttcagacgtttacccatcccgctttcgcttatatactcgtgtctttgctaacagcaaccagacggatttcatgtaccaacctgtcgctctatttattggcctgcgttacatgcgtgggcgtgcagcggatcgcttcggtcgtttcgtctcctggctttctaccatcggcattaccctcggggtgatggcgctggtcacagtattgtcagtgatgaacggctttgagcgcgagctgcaaaacaacatccttggcctgatgccacaggcaattctctcttctgagcatggctctcttaacccgcagcaactcccggaaacggcagtcaaactggacggcgttaatcgcgtagcacctgtcactaccggtgatgtggtactgcaaagcgcgcgcagcgtggcggtcggggtgatgctgggtatcgacccggcgcaaaaagatccactaacgccgtatctggtcaatgtgaaacaaactgacctcgagccggggaaatataatgtcatcctcggtgaacagcttgcctcacagttgggcgtcaatcgcggtgatcaaatccgcgtgatggtgccatctgccagccagttcacgccgatggggcgtattccaagccagcgcctgttcaatgtgattggcactttcgccgccaacagtgaagtcgatggctatgaaatgctggtgaatattgaggatgcctcgcgtctgatgcgttatccggcaggcaatattaccggctggcgtttgtggctggatgagccgctgaaagtcgactcattaagtcagcaaaaactgcctgaaggcagcaaatggcaggactggcgtgaccgtaaaggcgagctgttccaggccgtacgcatggaaaaaaatatgatgggcttgctgctgagcctgattgtcgccgttgcggcgtttaacattattacctcgctgggactgatggtgatggagaagcagggcgaagtggccattcttcagactcaggggctgactccgcgtcaaatcatgatggtctttatggtgcaaggggccagcgccgggattatcggtgcgatcctcggagcggcgcttggcgcactgcttgccagccagttgaatgatctgatgccgataatcggcgtcctgcttgatggcgcggcgctgccggtcgctatcgagcctttacaggtcattgttattgcgctggtggcgatggctatcgcgctgctgtctacgctttacccttcctggcgcgctgccgccactcaacccgctgaggctttacgttatgaataagatcctgttgcaatgcgacaacctgtgcaaacgctatcaggaaggcagtgtgcaaaccgatgtactgcacaatgtcagtttcagcgtgggcgaaggtgaaatgatggcgatcgtcggcagctctggttccggtaaaagcaccttgctgcacctgttaggcgggctggatacgccaacctccggcgatgtgatctttaacggtcaaccgatgagcaaactgtcgtcggcggccaaagcggaactgcgtaaccagaagctgggatttatttatcagtttcaccacctgttgccggattttaccgccctggaaaacgtggctatgccgctgttgattggcaagaaaaagcccgctgaaatcaacagccgtgcgctggagatgttaaaagcggtggggctggagcatcgtgcgaatcaccgcccatctgaactttctggcggcgaacgccagcgtgtggcgattgcccgtgcgctggtcaataacccgcggctggtactggcggatgaacctactggtaacctcgatgcacgtaacgccgacagcatcttccagttgcttggggaattgaatcgcttgcagggcaccgccttcctggtggttactcacgacctgcaactggcgaaacgtatgagccgccaactggaaatgcgtgatggacgtctgacggcggaactgagcctgatgggggcggagtaatggcgatgcctttatcgttattgattggcctgcgttttagccgcggacggcgacgcggcggcatggtgtcgttgatctccgtcatttctaccattggcattgccctcggcgtggcggtattgatcgtcggcttaagcgcgatgaacggctttgaacgcgaactgaataaccgcattctggcggtagtaccgcacggtgaaattgaggcggtagatcagccgtggaccaactggcaggaagcactggataacgtgcagaaagtgccgggcattgccgccgctgcgccgtatatcaatttcaccgggctggtggaaagtggcgcgaatctgcgcgcaatccaggtgaagggcgttaacccgcaacaggaacagcgtctgagcgcattaccctcgtttgttcagggggatgcctggcacaattttaaagcgggcgaacagcaaattatcatcggcaaaggcgtggcggatgcgctgaaagtgaagcagggcgattgggtgtcgattatgatccccaactcgaatcccgagcataaactgatgcagccaaaacgtgtgcgtttgcacattgccggtattttgcagttgagtggtcaactcgatcacagttttgccatgatcccgctggccgatgctcagcaatatcttgatatgggttccagcgtgtcaggtattgcccttaaaatgacggatgttttcaacgccaataagctggtacgcgatgcgggtgaagtgaccaacagctatgtttatattaaaagctggattggtacttacggctatatgtatcgcgatatccagatgatccgcgccattatgtatctggcgatggtactggttattggcgtggcctgtttcaacatcgtctccaccttagtgatggcggtgaaagacaagagtggcgatatcgcagtattaagaacgctgggggcgaaagatggtttaattcgcgccatctttgtctggtatggattgctggcagggctgttcggcagcctgtgtggtgtggttatcggcgtggtggtttcacttaaacttaccccgattattgagtggattgaaaagctgattggtcatcagttcctctccagcgatatctattttattgacttcctgccatcggaattgcactggctggacgtcttctacgtactggtcacagcattgttgctgagtcttttggcaagttggtatccggcgcggcgcgccagtaatattgaccctgcgcgagtccttagcggccagtaaaggcagtacattaaaacaaggagcggcaatgtattacgggtttgatattggtggaacaaaaattgcgctaggcgtgtttgatagcggtcggcagttgcagtgggaaaagcgggtgccgacaccgcgtgacagctatgacgcatttttagatgcagtgtgcgagctggtagccgaagctgaccggcgttttggctgtaaaggttctgtcggcatcggtattccgggaatgccggaaacagaagatggtacgctgtatgccgccaatgtccctgctgccagcggtaaaccgctgcgtgccgacctgagcgcacgtcttgatcgcgatgtacgccttgataacgatgccaactgttttgccctttctgaagcatgggatgatgaatttactcaatatccactggtgatggggttgattctcggcaccggcgttggcggcgggctgattttcaacggtaaacccattaccggtaaaagctatattaccggcgagtttggccatatgcgtctgccggttgatgcgttaaccatgatggggctggatttcccgttacgccgctgcggctgtggtcagcatggctgcattgaaaattatctgtctggtcgcggttttgcgtggctgtatcaacactattatcatcaaccgttgcaggctcctgagatcattgcgctttatgatcaaggcgatgagcaggcaagggcgcacgttgagcgttatctggatttattagcggtttgtctgggaaatatcctgaccattgttgaccctgacctggtcgtcattggtggtggcttatcgaatttcccggcaatcacaacgcaactggcggaaaggttgcctcgtcatctcttacctgtagctcgtgttccgcgcattgaacgcgcgcgccacggtgatgcggggggaatgcgtggtgcggccttcctacatctaaccgattaatcaacagaggttgctatgctgtcgcgtcggggtcatcggttaagtcgttttcgtaaaaataaacgccgcctgcgcgagcgtttgcgtcagcgtatttttttcagagataaagtggtgccggaagcaatggaaaaaccaagagtactcgtactgacaggggctgggatttctgcggaatcaggtattcgtacctttcgcgccgcagatggcctgtgggaagaacatcgggttgaagatgtggcaacgccggaaggttttgatcgcgatcctgaactggtgcaaacgttttataacgcccgtcgtcgacagttgcagcagccagaaattcagcctaacgctgcacatcttgcgctggcgaaactgcaagatgctctcggcgatcgctttttgctggtgacgcagaatatcgacaatctgcatgaacgcgcaggcaataccaatgtgattcatatgcatggggaactgctgaaagtacgttgttcgcaaagtggccaggtcctcgactggaccggagacgttacgccagaagataaatgccattgttgccagttcccggcacccttgcgcccgcacgtagtgtggtttggcgaaatgccactcggcatggatgaaatttatatggcgttgtcgatggccgatattttcattgctattggtacttcggggcatgtttatccggcggctgggtttgttcacgaagcgaaactgcatggcgcgcacaccgtggaactgaatcttgaaccgagtcaggttggtaatgaatttgccgagaaatattacggtccggcaagccaggtggtgccagagtttgttgaaaagttgctgaagggattataaagcgggaaaaattgcctgatgcgctacgcttgacaggcctgtgaaggggcgaaattaattgaatttgcgggttttgtgggccggataaggcgttcgcgccgcatccggcaactttactgcctcttttaccgtttactcgtccatagtaacgcggcaataaacgtacagacaccaatcagccctgcccagagtggcgatattctggtaatcgcaaagctgttatcgatatacaaacataaagcctgataacccatattggcaacagccatcgccactgcaaattttaacgcataataaaggcgcgttgtgtagttaaaaaatgcagcaaagacgatgaatgcaactgcccaggcaaaaaggcctaatgtcgtggtactgccgggtggatcattttcatgctgttgtccgggatgcggataatatgtcagtggtggcgtcggttgttttaatatctgtgcttgtaaaacagccaatgcattattgataccctgataccagagatccgcatgtaaataagccagcgtgtgattttctaccagaaggccgagatgtttatcgtccatactgctttcgacctggccgttggttatcataattaaccgtggctcgcgggtagtaaagagtaacagaacacttccttttacattactcattgaagatgccgcatgcgccagcatcgctttgccattttgcctgagactggcttcattattaatgtcgggtaaaaccacaataaacggtacaactccggtttgttggcgaaaaagttcggctttatgcgcgatctcttcagcatctggtacagtaccggtaacatccgtaaaaagtgtcttcattattggaattaagggcttactgattgccgtcagaggcaggaacatcagtaaactgagcagtatcatgatttttttcatgggcgggacttccgtttcctgcgtgtctttttagaggagggcatactgattaataaaccgacggcgataaaaataacgcccataatgccgataaacccccatttaaaaaaattaacccacgggttatttatctcagccttttcaggatgtcctggagaataataaacattaactttatcgccttcgctgtcttcataaaaatcgctgccaatactcgaattgaaaattagcgtgtaatctggcgtcggacgaaaggcaacgacgggataccacgaaccatttttacccgtgcgatgagaatgactggagtgccagacggtatcaacaatgacgccttcagtatgaatcgcgtctttgctataggtgaactggttataaaagataacaacagaaatgaggatcagtaccagaccgataccgaagaatatacgaaagaaaactctactgtcctggctcattagccacatccttgctaaataaaaaacgggcggtaataccaccgcccacttgctgaattaacgtcctgctttcagcttctgataatactcttcataaatgctgctggcggagcctacgtcattttgccattcaccatttttaatggtttcagcatccgggtagagcgttttatcgttcgccacttccggacttaacagcttacgcgccgcaaggtttggcgttggataaccgatagtttcagcaacctgttttgccacatccgggcgcagcaggaagttgatcaatttcagcgcgccttctttgtttttggcatttgccgggatcgccaggctgtccatccagaaaatgccgccttctttcggccataccacatcaattggcgtacccgcctggcgtgcaacgaaagcagaaccgttccagatcatgccgaggttaacttcgccttccatatacgggttagcggggttatcggagttaaacgccgcgacgtttggcatcagttttttcagctcgttgtatgcagcttcaatctctttcggatcggtggtgttaccggagtagcccagcttacgcagcgccatctggaacacttcacgggcatcgtcggtcagcagcaggctgcctttgtactcaggcttccacagatcggcccagctggtgacagatttcggatccaccgcatcaccgttaacgccaatcgccgttgcaccccagatatacggaatggaatagtcgttattcgggtcaaacggcttgttgagcatgtctggatcgaggttgctgaaattgcttaacttcgacttgtcgatcttctggatcatcccttctttacgcattttatcgacgtaataggttgaaggaaccaccaggtcataggcaccgtctttgtacgttttcagcttcgcgtacatggtttcgttcgactcgtaagtcgaatagataaccttaataccggtttctttggtgaactgttcaagcagtcctggcggcacgtactcggtccagttgtagaaatacagcgtgttgttgtcatcggcgtgagcggcgctcatgcccagtgccagagcacccgccgcgagcaggtggcgtgaccattttttcatttaacgtcccctgtgttacctttcgttttatcacgagcaataagctggctggcaattaccatcaccagcgacagcaccagtaatatggttgccagcgcgttaacttccggcgatacgccgactttgaccatcgaataaatttttaacggcagaatttcataactcggcccggtgacaaacgaagaaaccaccacgtcgtccatcgacagggtaaagcttaacacccagcccgccgctaccgctggcattgccagaggcagaatgatttttcgcagaatggtaaattcgctggcaccgagatctttcgccgcttccagcattcgcacgtcaaaacctttcaggcgcgaatacactgtcaccaccacaaatggcaggcagaaggtgatatgcgagaacagcagcgaccagaagccaagctgaatacccagcagcataaacagcaccagcagcgaaatcgccatcacgatatctggtgacatcatcaccacaaacagcattccgctaacgaacggcttaccacgaaagcgataacggtacagcgcaactgccgtcagtgaaccgataagcgtagcaaacgtcgccgaaaacaccgccattgttagtgaatgctgcgctgcctgtaacaggctgtcgttgttcatcagcaggctataccatttggtggtaaaaccctgccagttgatgccaaagcgcgagctgttaaaggagttcacaatcaaaataatgattgggatatacaggtacgcgtagatagcggtcataaaaccgccgcgaagcagtcgaccgatcattcgagttccaccttcttattcagcagacgagaagcgcgccagtaaaccagcaacatcaggcccattacgatagtcagcgtaatgctggtggctgcaccaaacggccagtcacgaatattgaggaactgtaccttgatgacgttaccgatcagcaggtttttcgcaccgcccatcaggtcggacacatagaacaggcccatcgctggcagcatcaccagcagacatccggcaataattcccggcatcgttagtgggataatgatgcggataaaggtctgcaacttgctggcaccgagatcgcgcgccgcctcaagcaacggcttatccagtttttcgatactggagtacagcggcatcaccataaacggcagcagaatgtaaaccagaccgataatcaccgcactaggcgtgaacatgatgcgaattggtgtatcgataacgcccagccagagcaaaaactcgttgagatagcctttggtgctgaggaaaattttcagcccgtaaatacgaatcaatgagttggtccagaacggaacaatcagcagaaacagcagcagcggacgcaccttgtgtggcagcttcgccagaaaccaggcaaaaggatagcccagcaccaggcaggcgagggtggcgatcagcgccatattcagcgagtgcaatagcacttcaaaatagagcggatcgagcagacgcgtgtagttatccagcgtaaagaccattttgacgaaactggcgtcgtcgcgggtcaaaaagctggtgccaatgatcatcaggttgggcagaaagacaaacaacacaagccaaccgacaatagtgacaatcactacattctggaacttacttgtgttcttcatcagccagtacgacctcccagctttctacccaattaatggccattttttggtcgagagagtggtcaaagtcaggatcgtcttcattgaagaattcgctgaccatcaccatcttgccattttccagctcaacaaccgactccagcgtcatgcctttgtagttacgctcgcgaacgtaaccaatcagcccttcggcgtggttgtcgtcgttaatctcttcaacacgtaagtcttccgggcgcagcagaacatgcagtttttgccccggttcaacggcgaagttaacgtagatattacattcgcggccttcaacgttggcgcgtacgcgctgctcgtcgagacgtttgatgacagtggcgttaaacatattgatttcgccaataaacccggcaacaaacaggtttttcggctcttcgtagatttcacgcggcgtgccgtcttgctcaatgcgaccatcgcgcatcaccacgatcctgtccgacatggtaagtgcttcttcctggtcgtgagttacgaacacgaatgtaatgccaagcttacgctgtaacgctttcagctcgttctgcatttgcttgcgcagtttgtaatccagcgctgagagcgactcatccagcaacaacagacgaggcttgttaaccaccgcgcgagcaatggcgacgcgttgctgttgaccaccagagagctgatgcggtttgcgttgagcgaaggtttccagctgcaccatccgcagggcttccatcacgcggggcgtaatttcagcagcgggggttttttgcatgcgcaacccaaaggccacattttcgaacacggtcatgtgggggaaaagtgcgtagctttggaaaacagtgttcacatagcggttttccgccggaacgtgggtgatgtcctcgttatccagcatgatgcgtccggaatcaacagtttccagacctgcaatcaggcgaagaacggttgttttaccgcagccagaagggccaagcagcgtgaggaactcgccattgttgatagtcagatccagctggggaatgacctctttaccatcaaagcatttgcgaattcccgccaattgcaccagcggtgaaagcgaactcggttgtttattcaattttttactctgtcccatgtaaacgcaacggatggcttaccgatgcggggtttgtggttaaccaccttggtgactcttaatgagggcggtaattctacggcaaaccgcttgaatcgccaatctttgttgtgaattactggcttagctttatattcattaaggtaatgctgataaatattcccgcttgcagggctaaaagtgacctgacgcaatatttgtcttttcttgcttcttaataatgttgtcacaaaaagtgagggtgactacatggataaactacttgagcgatttttgaactacgtgtctctggatacccaatcaaaggcaggggtgagacaggttcccagcacggaaggccaatggaagttattgcatctgctgaaagagcagctcgaagagatggggcttatcaatgtgaccttaagtgagaagggcactttgatggcgacgttaccggctaacgtccctggcgatatcccggcgattggctttatttctcatgtggatacctcaccggattgcagcggcaaaaatgtgaatccgcaaattgttgaaaactatcgcggtggcgatattgcgctgggtatcggcgatgaagttttatcaccggttatgttcccggtgctgcatcagctactgggtcagacgctgattaccaccgatggtaaaaccttgttaggtgccgatgacaaagcaggtattgcagaaatcatgaccgcgctggcggtattacaacaaaaaaacattccgcatggtgatattcgcgtcgcctttaccccggatgaagaagtgggcaaaggggcgaaacattttgatgttgatgccttcgatgcccgctgggcttacaccgttgatggtggtggcgtaggtgaactggagtttgaaaacttcaacgccgcgtcggtcaatatcaaaattgtcggtaacaatgttcacccgggcacggcgaaaggagtaatggtaaatgcgctgtcgctggcggcacgtattcatgcggaagttccggcggatgaaagcccggaaatgacagaaggctatgaaggtttctatcacctggcgagcatgaaaggcaccgttgaacgggccgatatgcactacatcatccgtgatttcgaccgtaaacagtttgaagcgcgtaaacgtaaaatgatggagatcgccaaaaaagtgggcaaagggttacatcctgattgctacattgaactggtgattgaagacagttactacaatatgcgcgagaaagtggttgagcatccgcatattctcgatatcgcccagcaggcgatgcgtgactgcgatattgaaccggaactgaaaccgatccgcggcggtaccgacggcgcgcagttgtcgtttatgggattaccgtgcccgaacctgttcactggcggttacaactatcatggtaagcatgagtttgtgactctggaaggtatggaaaaagcggtgcaggtgatcgtccgtattgccgagttgacggcgcaacggaagtaagcgaaaagggatgcggcatgtgatgccgcatccggcttaaatccaaacttacccttcgaagaaccagtatccgctattgaccagcgccgcgagcatcgcgaggaatgacggatcttccagcgcatcgccaaaattctccgcggtcagcgcaatgttgctggcgagcgcatccagtgccggacggtgcggggaatcgatcttctcaccattggcatacacgtcgtcgccaatgcgcaatacgcgcagaccccccaggcgcaccagcacatcaccttgtttcagcgcatcgtagatttcatccggctgataaggcggctctggcggcgcgatatccagttcatgacgtgactgggatataaactcgccaaaccattgtttaaagtgttccggctggttgatcaattcgagcatcatctcacgcagtttatccatctcttgcggcagaacgtccgcaggatgagcgcgaggtggaacatcaggatcgctgtagtagttgccgcccagttcacgttgcagcacataatcggcaaatccgctaatcagttcccgcgtatttggtgcgcgaaaacccacggaatagttcatcgcattttccagcgcgtagccttcatgcgggaatcctggcggaatataaagaatatcgcctggctccagctcttcatcaataatcgcttcaaacggatcaacctgtaacagatccgggtgagggcagtgctgcctcatatgcagtttttcacctacccgccagcgacggcgacctgtaccctgaataataaacacatcgtactgatcgagatgcggaccgacgccgcctccaggcacggaaaacgagatcatcagatcatcaatacgccagtccggtagttcacggaacggtcgcattagcgcagcggtcggctcatgccagtggttcactgcttgcactaacaatgaccagttagtttcaccgagatgatcgtagctttcgaatggaccgtggctgacctgccatttgccatcctgatgactgaccagtcgactgtcgacttcgctttccatcgccagacccgccaactcgtctggagagatcgggtcaataaaattattaaagccgcgttttaacaccaccgggcgtttctgccagtgacgttcaagaaaatcgggccagttaagagtgagttggtattccatgttaagcatccacaggctggtatctgcaaccgattataacggatgcttaacgtaatgcgtgaagtatggacatatttattcatctttcggcgcagaatgctggcgaccaaaaatcacctccatccgcgcaccgcccagcatgctctctccggcgacgattttaccctcatattgctcggtgatttcgcgggctaccgccagccccacaccttgcccagggcgtaaaatatcaacccgttgaccacggtcgaaaatgacctctcgcttgcttaatggaataccggggccatcatcctcgaccacaatatagagatgctcgtcggtttgccttgcagaaatttcgacaaactcgaggcaatatttacaggcgttatccagcacgttgcccatcacttcgacaaaatcattctgctcaccaacaaagctgatttctggcgagatatcgagagagatattgacccctttgcgttgatacactttgttcagcgccgaggtgagattgtccaacagtggcgcgaccggatgcagctcgcggctaagcaatgtcccgccgcgcatactggcacgatgcaggtagtagccaatttgctgtgaaatgcggctgatttgctccagcattaccggctcagcatcactgacgctcatcttctcactacgcagagaacgcagcgtactttgcagcaccgccagtggcgttttcagactatgggtcaggtcggtgagcgttgtacgatatttgtcgtaacgttcgcgttcactttttaacagtcggttcaggtttcgtaccagactggtcagttctcgcgttgtggctggattgagcaattcacggttatgttcttccagttcgcggacttcttttgccagggcttcgatggggcgtaaactccaccaggcggcgacccacagcagcgggatcactaacagcagattggctgagagcacatagataaaccagctccagaccatataggaactttttagctccaccggaatggtatccaccaccacaatggttaactttggcatccgcgatgttgccgggtagacgtttaccgccaccgagtgggtcatctccgcgtcgtcatcatcttcccgcacttcctgcaactgttgctgtatcgaatgatctccactcagcaagaggctggtatcgttaacatccgcttcaatttcatgaaaaccattcgatttcagccagtcaggctggatcatcttcatcagccagggcacgtcacgttgcgcccataaaagctgcccgttctcatcataaattagtgtcatcgtggggctttgcttgtcgatattttcgggtaactcgacatgcaacttattgttttcccacttcgcaagggtatagaacagattgctctcgccacgtaacagccgaaacgtggttttatcgaaactgacgctataaccgatcagcgcaaccattccgtaggcaagcgaaagcaccaatactactgctgccgttgctaacagaaaacgtacccgcagcgagagcgggaaaaaaagatgcagtaattttttcatcagcgcaattcgaacagatagccctggccgcgaacggtggtaatcacttcttgcggatattgtgcctgtatttttttgcgcagacgtcccatcagtacatctatggtatgactttcccgcagctccgcatccggatagagttggagcattaacgaatctttgctcaccactttgccattattgcgtatcaacgtttccataatggtgtattcgaacgcggtcagtttgatcacttcgtcattaatagataattcacggcgggagagatcaacctgaaacggtggtagcgaaatgacctgtgaagccagaccgctattacgccgcattaatgcctgcattcgcgccatcacctcttcaatatgaaacggtttagtcacgtaatcatcagcaccggcacttaatacttcgactttgtcctgccagctctcacgggcggttaataccagaatcggcagtgaaacatcattgctacgccagcggcgaatcagtgacagaccatcctcgtcaggcaatccgagatcgacaatcgcaatatcaggtaaatgttcattgagataataatcggcttctttggcatcttctgcgtcatcgacctgatgaccagcatcctgtatctgaactttaagatggtgacgtaacaacgcattgtcttcaacaaccagtacgcgcatttttatttctccctgtcttaattattaaaatagtgtaacgcgattatgtggttatgggggtaaacattaaataaaccagcgggaaggggaggtaaagtgaaaaaacaaaaagtggataatcttaataagcaggccggacagcatcgccatccggcactgttttgaggcttatttcagctcatcaaccatggtgatggcgcgaccaatgtagttagccggcgtcatcgctttcaggcgggctttctcttcttctggcaacgccagaccatcgataaactgcttcatgccttcggcgtcaacgcgcttaccgcgagtcagctctttcagcttctcgtacggtttttcgatgccatagcgacgcataactgtctggattggttcagccagcacttcccagttgtgatccagttcatccagtagatggtcacggttcacttccagtttgctcacgcctttcagggtggattgatacgcaatcagcgcataaccgatacccacgccgaggttacgcagcacggtggagtcggtcaggtcacgctgccagcgggaaactggcagtttgcttgccaggtgctgcaataccgcgttggaaaggcccaggttcccttcggagttttcgaagtcgatcgggttaactttatgcggcatggtggaagaaccaatctcaccagcaatggttttctgtttgaagtggttaagggcgatataaccccagacgtcacggtcaaagtcgatcagaatggtgttgaagcgcgcaacgcaatcaaacagttcggcaatgtagtcgtgcggttcgatctgggtggtgtacgggttccactgaatacccagcgaggtgacgaactcttcgctgaactgatgccagtcaacttccgggtaagcggcgatgtgggcgttgtagttaccgacagcgccgttgattttgccgaggatctccacctgattaagctggcggtactggcgctccatacggtaggcgacattagccatctctttaccgatggttgacggcgtggctggctgaccgtgggtacgagacagcagcgggatatcgcgatactgaacggcgagatctttaatgccatcaatcagttgacgccagtacggcaggatcacttcatcacgcgcggttttcagcattaatgcgtgggagaggttattgatatcttccgaagtacaggcaaagtggatgaattcagaaaccgcgtgcagttccgggatatccgccactttttctttcaggaaatactcaaccgctttaacgtcgtggttagtggtacgctcgatggttttgatgcgtgctgcatcttcttcgctgaaactggcgacaattgcatcaaggtaaccgattgcgtcggcagcaaaagcaggaacttccttgatcgctgcgtgcgcggccagtttttgcagccaacgtacttcaacttgtacacggaatttcagcaaaccgtattcgctgaaaatcccgcgcagtgcgctgactttatcgccgtagcgtccatcgacaggggaaacggcggtcagtgaggataattccatagatcacaactccggggttaaatgagcaagaatttgttttgcctgagtggtcaggcgattacgagaaaacatcagttgcagacgaccgccgccgacctggtgccagagcacggcggcgcgaatgcctgccagcagggttgcgcgaactttcgcctgcacctgtgggctttgcagtacagcaggggaaccagtgacctgaatgcgcgggccaagcgggctgataacatcaacatagatggcagccatcgcgctcatcagcgtttcggactgtaaatcgaagtgttcgagctggcgttgcaggccgttgatccggttgcccagagtgtcgagcgcacctttcgctgaggagagtttgcgctcaagcaccatcagactgagtgtgtagcgggttaattcggcgtttaagccctggcgactgctggcattgagtacgccgagcaaggtttccagcccgacgcgcaggttggcttcgctaccgccaaaaaccgccagcgttgagctggggttcatatcgataatactgttgagtgagacgtgtagcgcatcgccatcacaatgcccctggtgagcgagttgttgcaccaggcgtgccgactgacaaataccggcaagggcgagggtgatgtcatagtaattctttgccacgttcactgcttccttgttttaagtaaagataataatcagaccggcagcggcagacgctgctcaataataccgccaccgaggcacacttcaccgttatagaaaacggcagactggcccggcgtcacggcggcaaccggctcatcgaaaatcacttcaatgcgatcagcgtccagcgccttgacggtgcacgggatgtcggtctggcgatagcgggtttttactgtgcaacgcatagtaccggtgaacggctcgcgatcgacccagtgcagctgctgggcaatcagaccgacagacatcagacgcgggtgttcatggccttgcgcaacaatcagaatgttgttttcgacgtctttatcgaccacataccacggttcttcggtgccgtctttggtgccaccgatacccagacctttacgctgaccgagggtgtgatacatcagcccctggtgctcaccaatttcatcgccatcgacggtaatgattttgcccggttgcgccgggagataacggcccaggaactcgcggaatttacgctcgccgataaagcagataccggtagagtcttttttcttcgcggtgaccagaccgagatcttcagcaatcttacgcacctgcggtttttccagttcgccgaccgggaacaggctttgcgcaatttgctcatggctgagcgtataaaggaagtagctctggtctttattgctgtccaggccacgcagcaggcggctcttgccatcgacatctgcccgacgtacgtaatgaccggtagcgatataatcggcacctaaatcttcggcggcaaattcgaggaaagctttaaatttgatctctttgttgcacagaatatccggatttggcgtgcgaccggctttatattcggcaaggaacagttcgaagacgttgtcccagtactcggcagcaaagttaacggtgtgcagttcaatgccgagcttgtcgcagacagcctgggcatcagccagatccgctgccgctgtgcaatattcctcaccgtcgtcttcttcccagttcttcataaacaggccttcgacctgatatccctgttgttgcaacagccaggcagaaacggaggaatcgacaccgccggacatgccgacgattactttttttgcggtttcagacattggatcactcacgacattgaacttcaaggcggcgtattctatcacgcagccttttagatgacaccctttgtaaaaggccagttaaaatcgccaatcatctccagcggatagcgttgcccgctttgataacaacgaatactttccgccaccagcggcgaacgaagatttgacgcctgtaaaatttcttcggtgctgacccaacggcagcagtcgatatcgctgtcatgaggctgcgtcgggcatatttgctcaagctcaatggcaaagaggaaacgcaaaaacggcgttttatccggcgcaatccactgatgcatacgaataaagtgttgcggctgcgcgctaatgccggtttcttcccacagctcacgggcggcggcttccactaaggtttcatcggcttccaggtgcccggcaggttggttccataacgctttaccattaatcgtctcttcaacgactaaaaatttgccttctgcgtgcaccacgcaggcaacggtaacgtgcggtttaaacattttgcatccttaatctgtcgcgtctcgccattcgccattggcaagattatccaaagagtaatcccccatcgcatagcgaatcagtcgcagcgtggggaaaccaacatgggcggtcatgcggcgcacctggcgattacgtccctcatataaggtgatcttcagccagctggtgggaatacttttgcgctcacgaattggtggattccgcggccataaccacgcgggttcttcaaccagctccgcgcctgcgggcagggtagggccatcatttaaggttacgccattgcgcaaggcttcaagtgcgtcttgtgtgggaataccttccacctgcacataatagatttttccggtgcgtttacccggctgggttaaacgcgcctgcaacgcgccgttattggtcagcaccagtaacccttcgctgtcgcggtcgagacgacctgccgcatacaccccctgaaccgggatgaattcttttaatgttttgcgtccggcttcatcggtgaactgcggaagaacatcgtagggtttattgaacaggatcacacgcgtgggctggttttcaggtttacgcctggtagaacgttgcgagctgaatcgcttaacctggtgatttctaaaagaagttttttgcatggtattttcagagattatgaattgccgcattatagcctaataacgcgcatctttcatgacggcaaacaatagggtagtattgacaagccaattacaaatcattaacaaaaaattgctctaaagcatccgtatcgcaggacgcaaacgcatatgcaacgtggtggtagacgagcaaaccagtagcgctcgaaggagaggtgaatggaaagtaaagtagttgttccggcacaaggcaagaagatcaccctgcaaaacggcaaactcaacgttcctgaaaatccgattatcccttacattgaaggtgatggaatcggtgtagatgtaaccccagccatgctgaaagtggtcgacgctgcagttgagaaagcctataaaggcgagcgtaaaatctcctggatggaaatttacaccggtgaaaaatccacacaggtttatggtcaggacgtctggttgcctgctgaaacccttgatctgattcgtgaatatcgcgttgccattaaaggcccgctgaccactccggttggtggcggtattcgctctctgaacgttgccctgcgccaggaactggatctctacatctgcctgcgtccggtacgttactatcagggcactccaagcccggttaaacaccctgaactgaccgatatggttatcttccgtgaaaactcggaagacatttatgcgggtatcgaatggaaagcagactctgccgacgctgagaaagtgattaaattcctgcgtgaagagatgggcgtgaagaaaattcgcttcccggaacattgcggtatcggtattaagccgtgttcggaagaaggcaccaaacgtctggttcgtgcagcgatcgaatacgcaattgctaacgatcgtgactctgtgaccctggtgcacaaaggcaacatcatgaagttcaccgaaggcgcgtttaaagactggggctaccaactggcgcgtgaagaatttggcggtgaactgatcgacggcggcccgtggctgaaagttaaaaacccgaataccggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggtggtatcggtatcgcccctggcgcaaacatcggtgacgaatgcgccctgtttgaagccacccacggtactgcgccgaaatatgccggacaggacaaagtaaacccaggctctattattctctccgctgagatgatgctgcgccacatgggttggactgaagccgcagacctgattgttaaaggtatggaaggcgcaatcaatgcgaagaccgtaacctatgacttcgaacgtctgatggaaggcgctaaactgctgaaatgttcagagtttggtgatgcgatcatcaagaatatgtaatcactacatgtgttaaatattgaaacgggcgtataacacgcccgttgttttatgatgatgtaaaatcttccccaaaactttccccaaaacccttccccaaaactggctattttctatgctgttttgatatctacgataatccagtctttaccacgatcatcattgtatcggtcggtcatttttctggatttatggcctaacaacttttgcgtatccagaccctgttcccgatataaccgttctgacagagatcgctgctcatgaaatgtgggcgcagttccttgctcccattttatgccacatttttccctggcctttttaaaagccgttgtcagagtattcgcagaaacctggtctcctctgtttgcttgagaggttgtgtgacggtaatggaccagatatttactaacaacagcatcccggtaatgactccaacttactgatagtgttttatgttcagataatgcccgatgaccttgtcatgcagctccaccgattttgagaacgacagtgacttccgtcccagccttgccagatgttgtctcagattcagattatgtcgctcaatgcgctgagtgtaacgcttgctgataacgtgcagctttcccttcaggcgtgattcatacagcggccagccatccgtcatccataccacgacctcaaaggccgacagcaggctcagaagacgctccagtgtggccagagtgcgttcaccgaagacgtgcgccacaacagtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtaccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattaccgtcgttctccagtattcgtctgccctccaaatcggatatttttatcagcggtcacgccattatattcacaataaacttcattaaccgctttaccatttgtcaccacatgaaagtgaccatcagcttttgcaatacatccaaatgtggttttctctgcaaatacatctgtcgctgcgctattaacatacgagcctgaagggtttgacagactcatatataacttaccactacctctgttgattgctgcaattgctgattgcccggtattggctgctgctatatcccacacgcggggtgcggcgtttggtgcaatatcccagtttttatgaatctcaagtgaaaaagtaaatggtaacttagaaagattatttctggtggggatactaaccaaatcactggctcttgtcgttgcgctgcctcctgaaataataaatgatgatacacacggcccattctctacttgtggggtggcaagataaatatagtcaccagatactgttgccccaccccgctcaggagaatactgtatctgagagcctatttttaactcaccatcaattgcctgaatcgttgcctctgcaaaaatccagcctgtggtcttatccttcctgactcgtgccgtaattctgccggcagcaccacctgtcatattaatttcaagcgtttgcgtatcaatgtacgcatcgccaagaaaagttgttgcactaccatcatacttatcaaaccgtatacgtaaccttacctgtcgttctgttttaaaacggcatgaggttgtcacgtacttattatcgcctgagacatcaactgactttgttgcagcaattgatgccatattaatagctgaggtttgcccaatcagagaatcgttacagacgaactttccataggtaaaaccaaaactatccttcccggtttcgggaatatccatatttaccgacttgccccaactggccggagtttccgaattcagcatgtaattagttctttgcccctcaatcagcagaccttcgcgctcaaatcgcggctcattaatttccgctgttttcagttcaccagatttgttgatataggttgccgttgatgcgcgcgtgaaactaacctgtttatcactggcgacctgaaccacatcgtcaccaatagctatttttttatagcccggagaaaaacccgcaatcatatccagtgaatcgttaaacggtatccacacatcaggcagcggcggcactatattcgcataaggctctgccgtcacttccgctgcgacttctgcgcggtctgccgccttttcagcccgtgtcgctgccgacagagcctcatcctttttctgcccggcctttgttgcgtctgctgcggcctcccgcgcttttgtggtggcgactccggcattttcagcggctgactctgcattacggcgggaagcctcttcactgtctgcggaggcttcttctgacgcacgggcatttgtctctgaacgttctgccgctgttgctgcgttttgtgcggctgtttttgaagaagctgccgctttcgcgctgttacctgcattcgtctctgatgttttcgccgcgttcctggacgatgccgctgctgtttctgatttctttgctgccgctgcgctctgagaggcggcttcagcgttgcgtgccacatcctccaccattacctcaaaacgacgcaatgcctccggcatgacatcctcttccgtcatggcacccagaaaatcattcagcgtacctggtctggaaccttcatagacggtaatggttccggcatgtgaaggcggaaaaccttcaaccagcaggatgacgctgtactggccatgctcaacatccatgctgtaacgcccggcttcatccggattttcagaggccaccgtgttcaccagtaccgtggtgctgttacgctttgccttcagttgaatagtgcagttctgtattggttttcccgcaccatctttcagcacacctgaaatctgtactgccatattcactccacaaataaaaaaggcgccatttctggcgcccgtatctgggttataaaattcagctaatcgtgatgcctgcagtggctttcttcatcaccacaaccagcaaatcgctgatacttgctgtgggataccagccatttaccagccatgccgatacagaaaattccagtgtcattacaccactgcctgcaggcatatcaataacacccgtatatatcagcgtattatccagagccgacggcatgaggagtagatatcagtatgatcttgctcatgtttagcgccactgaatgccaccgccggaataacaatttgccggtcaaacggctgatcgtcataaaccctgacggtaatggtccctgatggccaccgctccggtgctcgggagtcacgggggaaagctttgcccactgttttaacgagatcgccttcaatctggttcgcggacagttttcccagaacccggcagttctcgttaatcgtgacgttgttgagcgtcccggagttcgcattcacgttaccgctaatatcggcatttttcgccgtcagccgcccgtccggtgtcagggaaaatgccggaggattaccgccgctggtaatggtgggagccgtcagatatttcaggaacacttcgttcatgaatatctgatcgccctgaccaacaaacatcggctttgtgttgccattcgcaggattaatcatcgcaatcctgtccgccgccagcagcacctgactctgcataccgtcaggggtgttttcaataccggcaccaatacccgcgatataaaggcgtccgtcctgcatctgctgcagcttcacagcccacatgctgttcaggttattatttgtatcaacctgaaccttctgtatctgctggatggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggactgttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattaccgagaacgacatctgtttggccatattcgcaatttccgcatatggcataaagaattaaatgacaggcaattaaaagaggtcgtatgaaagatttaactttgaagtttcatgacaaactgcagtttaaggcctgaggtagcctgagtttaacggacactccttcctgaaatagaatggcatcagaaggagctaataatgagcagaaaaacccaacgttactctaaagagttcaaagccgaagctgtcagaacggttcttgaaaatcaactttcgatcagtgaaggcgcttcccgattatctcttcctgaaggcactttaggacaatgggttaccgccgccagaaaagggctcggtactcctggttcccgcacggtggctgaactggaatctgaaattctgcaactgcgtaaggcgttaaatgaagctcgccttgagcgagatatattaaaaaaagcaacagcgtattttgcacaggagtcgctgaaaaatacgcgttaatcgaacaatggcgacaacaatttcccattgaagcgatgtgtcaggtatttggtgtatccaggagcggttattacaactgggtacagcatgaaccctcagacataaaacaaagtgatgagcggctaaaactggagattaaggtggcacatatccgcactcgcgaaacatatggaacccggcggctccagacggagctggcagagaatggcatcatcgttggtcgtgaccgactggcacgtcttcgtaaggagctaaggctacgctgtaagcagaaacgcaagttcagagcgactacgaactcgaaccacaatctgccagttgcgccaaatctgctgaaccagacgttcgctcctacagcaccaaatcaggtctgggtggcggacctgacgtatgttgccacacaggagggatggttgtacctcgctggcatcaaagatgtttatacgtgcgaaattgtcggctacgccatgggagagcgcatgacaaaagagctgacaggtaaagccctgtttatggcgctcaggagccagcgcccacctgccgggctaatccaccactctgatcgaggttcacagtactgcgcatacgattaccgggtcatacaggagcagtttggtctgaaaacatcaatgtcgcgtaaaggtaactgttacgacaacgctccgatggaaagcttctggggaacgctgaaaaatgagagcctgagccactatcgttttaataaccgggatgaagccatctcagtaatacgggaatacattgagattttctacaatcgtcagcgtcgtcactctcgtctggggaatatctccccggcagccttcagggaaaaatatcatcagatggctgcttaaaaaaagaacaaatggtagtgtccgctattgccagtacacctcagccttcctgtcatctcttggctgggcggaagatgaagacctccagaataaactgttagttgatgaaattggtttcacctacacagaaacaggggtaacagaagagggagaacctgtctgtatccggaatgatggttattttgtcaacattcgcattcttgatgacttgtttgatgtttctgtattctctgattatgtcgtggagctggaaacaccgcttcgggaatggagctgaaaggaggaaataatggatataagccccttacttcatgcactttgtgctgtggctgcgcagatactggttggtctttttaccggaaactgggcttacggagcgatagccggttgtacgttcttcattgcgcgtgaacatacccaggcagaatatcgctggattgaaatgttcgggcatggcaagcgaatgaatatgccgtggtggggcggttttgatccgcgtgcttgggatgtggcaagcctgatggattttgctgtgccggtggtggcgtgtctgctggtctggctgttggttaatcgtgggtgaaaaaaggtgagctgtatatgcaacggaggaagaaaccccgttgctggaagccaggaaaaagtatcgggtgttgctgttctcggatgttgtgctaattgggtgataacagatcctgtgtatgggagtttccctttttgcgtgcgttgatgctggtaacggcaaacgtcatgatgaacaaaaccgcgaataagacgacaatcgtcggagctggtgcgctgtcgataaaaaaggacaaccagacaccagtcattgacactattaccgatatgccagtcgccagtaggagcgcaatatgaaagcgttgtgtcaggaataccgcaatggcgccaggcgcaatgagcagagaaatggagagaatgatacctaccgctttcagcgtcgccacaatggtcagagagaccatgcacagcagtccataatgcagccatctcgtatgcaaaccgcttacctgcgcctgttgataatcaaagctgaacagcaaaaaatcccgccattttacgctaataacaagtgtaaccagcccggcaataatcatcgtctggattatatcgccgatggttatcccgagcatgtcgccgaaaagaatatggtcaagatgtacgtctggtttgactgcaatatacaagatcagacctgcggcaaacatgccagaaaaaacaatccccatcactgtatcttgcttgattcggctgttgtctttcaggtatcccgtcgccaccgcgcagaatactccggcgacgaatgcccctgtagccaaaggtaaccccagaatccaggcaagcacgatgccaggaaaaaccgcatgactcatcgcgtcacccatcagtgcccaacctttcaggaccagaaagaccgacagcagcgcacagggtatggaaactaccagtgaaatcagcagtgcgtgacttataaaggtgaactgcagtggctccagtaataatgccatcatgagcgatcctccagcgccttatgcgcacgccgacgatttgccaaaagcccatgggtgggcgcaaagacaaatgctaaaagaaacagcagtgtctgcgccaccacgatgattccacctgtcgcgccgtccagaaagtaactgacccacgcgccgaggaaactggttacactgccaatagttacagcaatcatgagcaggcggggaaaacgatcggttaacaaccatgctgttgctccgggagtcaccaccagacagatcaccagaaaggcaccaaccgtttgcagcgccgcaacggtcgaaaccgacagcagggtgaagaagaggagttttaatctgcccggatgcaatccaatagcacgggcgtgattctcgtcgaaaaaggtcaccataagatctttccatttgaaaaaaagcacgatgatcgagagaatgccaatgatagtgagttgcaggatatccgccggatcgattgccagaatattgcccaggacgatggtctgaatgttcacagatgtcgggttcaatgacaccataaacagccccaggccaaaaaaggacgagaagatcaggccgatgatggcatcttcttttaagcgggtgcgttggttaagaaacagcatgctgcccgcagccagtccgccggaaaagaaggctcccagagaaaacggaagccccagcatatatgcccccgcaacacccgggacaatagagtgcgacaacgcatcgccaatcagcgaccagccttttagcatcagatagcatgacaggaaagcgcagagaccgccgaccatcgccgagacccacatcgcattgagcatatattcatagctgaagggttccagtagcacgttcatctttcttccctctgcaccgctgacggtcgatgagccacaaaagggcgttcatcgtcagtaataatgctttcttccgagccgttaagtgtgacatggcgcagtacgccgctaaaagccagctccaggttctcggctgtaaaagtggtgtctgtcggcccgcttgccaggacggtgcctttgaccatgaccgtataatcgcaaaatgtcgtgacggatccgagattgtgcgttgagacaagcatcgttttgccttccgcgcgtaactccctcaacaggctgatgattttggcttcggttttcacatcaacgccagtaaaaggttcatccagcaggatcacatcaccctgctgtgcaatcgctctcgccagaaagacgcgtttcttttgtccaccggaaagctcgccgatttgtcgatggcgaaaattcaccatatcgacacgttctagcgcatcggtgacaatttgacgatccctctttttggcgatacgcaacatacccatatgcccatagcggcccatcatcaccacatcttccaccagtacaggaaatgaccagtcaacctcttctgactgagggacgtaggcaaccaggtttttctgtaacgcctgtcgcgtgggaatacccagaacagatatctttccgctggtcagacgcacaaatcccataatcgctttaaacaacgtcgattttccggaaccgtttaccccaaccagagcggcaatagatccacttggtactgtgaaggatgcatcgcgcagtgctgtgtgcccgttacgccaggtgacagcaacatcattaacgacaatgcctgcagattgcatcattatttctcccttttcccggctttaattccctgtaccagcgtactggtagtaaccttaagaaggtcgatatatgtcggtaccgggccgttttctgtgctcagggaatcgacatagagtacaccgccatagtgtgcgccggtttcacgcgcaacctgacgcgctggtttatcggaaatcgtactctcgctaaagactgccgggatatgatttttcttaactatatcaacaaccttacgtacctgctgcggtgttccttgttgatcggcattaatcggccacagataaagctcttttagccccaaatcgcgtgcgagataagaaaaagccccttcactggtgaccatccaccgctgattctcagggagttccgtaatctgcttacgcaggggggcaaaggtttgggtaatcttggctttataagtatcggcattgcgttggtaggtttgtgcatttgccggatcgtattttatcaacgcatcacgaatattatcgacgtaaatcagagcattatctggcgacatccatgcatgggggttaggtttgccctcatagggtccttcggtgatccctacaggcgtcacacccgaagagacaattacttctggaaccccattgagatgctggtaaaagcgttggaaccacaattccagattcataccattggcgagaatcagttgtgccccctgcgcacgtttaatatcgccaggggtaggctgatactcatgaatttctgcaccaggcttggttatagatgagacttctgcagcatctcccgccacgtttttggccatatccgcgatgatggtaaatgttgtaatgaccttgaatttttcagttgcacttgcctgaaatgcgatcgagcaggtgagtgcgaggccccccaagagcatggttactttttttatcgagtgcataatttagtacctatagtgagcaaaattagaacaaacatagcaacggctatgttttatagcacaacctatataaaatgaaaatgattatcattagcaactttgaggcccaaaacagggattaggttgtttcctgctggcgacgtgttattgaggaaaaaagtaaggcagctagtaggctttgaaataacgttctgcggttggctgatgcaatttcgagagtgcatgtattgaatgatttctagccgttactgattttcgtattttttgtatgagatgatttgaacatcctctggcgttcatttatggcaaaaaggcttaagtttagaaaacatgcgttttagacgtaaaaaatcatttatttaatcacaacttatgtaatggcataatcaggttggtgaaagagagggcgtaaatggataaaagagctaaaaatcagatagtcgatagcgatattgcacgtttgttactcaagctcagaaagtctcgaaacttgactgttacagagcttgcccaacgatctggtgtcagtcaggcgatgatcagcaaagttgaacgaggcacctcaagccccagtgcaacaatacttagtcggttagctaatgcactgaatattacgctatcaaagctttttgcagagcttgagatgcaacagaattcacttgtacttttggctgaccagcaacaacactggattgatgaagaaacaggtattacccgctggtctttgtccccagcgggtgcatgtccggaactaataaaagttgaaatcccccctatggggcaattgactatccctgcctctgcaaatgagcatctttccggacaaactctatggatgttaaacggcagccttgattttcgagtcaatcatcagactcatcatttacaagccggtgattgtcttgctcttacctttgccagcgagtaccaaatgagaaacccagatagcggccagagttgttcttacattgtcgctttcagtcaaaaaaatccatgatgtaattctcctgaaataatcatgtcacattgccttataaagatgtaatagagggtagggtctgccttgattgtcccgctcggaacgtcctgaaagtttaaagcccatatgttgataaaaacctacagcttgatgattttgttcatttacatcaacgcttagatcaggatgtagagccagcgcatgtgagatcagatgtttcccgacgccaagtccgcgagctgacgcatcaacaaaaagagcctctaaatgtccctcatgcaaaaacatgaatcctagtggctgatcttcctggtttgttgctaccagcacaggggtttctgaaaaaaagctgacaacttctttttcaatctcctgccggtcatgggctgtaagaaaatcgtgtgtggcatcaacggaatttttccaaatttagataatttctggtgcttcagatggtcgcgacattctgatttttaacatgttatctcccttaaagtggtcgttgcttgtgtcttgagatacaaaacgagttatcaaatttactatagtgaaattaaattcacaatagtgatttggttcctgtgccttaacattacccatgaggagtacaattaaacgggttaatcagtttctccatttgaaagaaaatagacttctgtactgtttgatatcaccgctattttcttatttgctgtgcaggtcgtagtgggacaaaactgagacacataaggtctagcaatggcttgcaaggcctcacatgtattgagatgttaataaaatgtagacttgtaattttgatataaatggtagagaaaatctttccccaaaataaaaacgaacgtcaatgaaatcaaacggttgaataaagttgattttggctaataaaaagacaataaaatgatttttatcattaaatatcaatgagttgaactcatggtttttatatactgctgcgccatatgggctggactgaagccgcagacctgattgttaaaggtatggaaggcgcaatcaacgcgaagaccgtaacctatgacttcgaacgtctgatggaaggcgctaaactgctgaaatgttcagagtttggtgacgcgatcatcaagaatatgtaatctctacatgtgttaaatattgaaacgggcgtataacacgcccgttgtttttataaatatgttaaccgttataaaataacgtatcaaaagtcaagtgaacacatttcaaatatcaatttgatcgtattggtctggtgattatttatggggagcaataaaaagacagtattaatcatccatagggatagtctctgcacttttatttccattatgctaatgccttactgaattatgaagcattttttaagctcccaactttagctagattaatggtttattattttctacatcttcaatatataaaagcgtattatcaatggcgtagtaactgcgtttgttatgattaacatcagtaacccaccggaaaacgccagcgcctgccagtgttgaacagtattcccgaaatgtagattttccgcgaatatgaagcaatgcggcctcttttattttagctgggttcttggtcgtactaacttttaacaggttcctggttcctcttaataacaaaaccgtgtcatcgtgagtaataattctgatgttatccgtagccagataataaatgtaatgtgcaatacggtgatgttttaattctgaataaaaccaggagaagttttgctcttttctcacttgctcaaacatcttttgaaaaacaacgacctgatccatcaggataataacctcttgttaggtgtgagactgcgtagtgtgcacgatcggttttaccacttcaatctggtctgtcctttggctgtgatatgtacaaagtgtgaaagggggattacctgaattctcccggtgggcattttgcaacggaccagctccgctacaaacgctgttgtgggttcagattataacattctgtctaaggggcgggataaaggtgaatttagggggcatgaaagatgactttataaccttgctcaccccagtgttgtaaaagttcgttttgccttctcgttggtgccatgcctgtccagacaatcaatgtttgcgttgggaacagttccgggcgcggcgattcaatgggatcagcaagaacagaaatgtgccatcctgacaatgataaacgccatgcttccagccacaatcgtgctctctcttcaacattccacgccatcagaatggcctctttaccgggcttacggcgcatttcgaaaagtgaggccgctgcgtattcaattaatgcgccgtcaaacatactgctcataatgcgggaggtgttgtgatcaagcacgagacgctggcgaacaggaaggtaaacatgattaatcaattgatctactgggtactctcgacccagtgaaataattcgcgcgcgtagtttggctggattagccatacgaagaattgacatcatctcttcttgcaggcggttccagtcatcttgcgtatcctggctggtagtttccagtaatgctttaactttgcctacaggaacgccattacttatccaacgcttaatctcttcgatgcgttgtatgtcttcttcatcaaagagtcggtgtccgccttcactgcgttgtggttttaacaaaccgtagcggcgttgccaggcccggagagtgacaggattaatcccgcaacgttcagcaacatcaccaatgctgtaataagccacaattcctccttgcgatcataaatctccgtcgcctctacacgacccaataatactttgtacaatatatgctaaaattgtacaaagtataaataagatttcagctaaattggatgaaacattatttttaatgtggattaaattaaaacataacgtattcattttcacgatgatttccagaaatcatgcgaaataatgtgctgaaaattattttttctccggccacgcaactgaagggataccattcaatttagctttggaaaacagatctccctgaaacatctcaattcctgcagattcaagccacatccactcttctggtgttgccacgcccatagcagagacttgaatttcaagtgatgtacagcatttcatgatcgcctgaataattgcctgccgtggtccgcttttatgaacattggtaatcaattcctgactgattttaattctgtcaggctggaagcgtgacaggagtaacaaaccagcaaaacctgcgccaaaatgatcaattgctacactgataccggccgcctttagcgatttaaccgcttcggcaaactcatcaaaccgagatatgacttcactttcagtaaattcaacgatgatttgttcaggtaccagagcattggcctttatttcatcaagtaaaaaagagactgcgtcaggtttgttaaccagggtcataggtaatagattgattgaaatcattttatcaccgagcttaagtgcgtgtgccatcgcaaatgcaagcgccttacttttgagatccgctgtgtagatttcctcgtctttacgctgcccaaccgctatagctgacgggctgtcttcatttttttgcacaatggcttcaaaagcgattatccgccgcgataaagggtcgacaataggatgaaaggcaaagtggtcgtttatatttgatgaaagggtacaagaatcaagttctttatcagatccgtcagcgataaaaagccaggagtcttcagcaggaatctcgaaataggttgattgttcagttgcaaggacaaaagtacgaaaaaattgtagcgctctgtcatcataagttagctgaaattttgatgtgcctttgtcgaatacggcctgtaaaacgtcatctcgctcgtgcaggcgtaaatcaaataattccattcctgctttgccaaaacggcgagcaggcgcgtaatcgcacaacagttcaacaatattatagtgccgtggatcctggcatatggcccgatatatcatttgaacctgttcttccggaccttccagaagctggaaaaaatgagaaccattaaacagtaagatccctgttacgtcagaccgcatgttcctgcgatttgctatcgaaaccatttcttcaatttttttgacaggttcgtcgccacgtatatggctacgataaataagggtggtaagcattaacaatccagggtaatgggcgaggcgagagtaagacggtaacagacatatcttcttgtgtctttcttttaataccaaaacataaccgtttctttacattgataaaaagtggaaaaggttgaagacggtttggcgaaaaaacctgtataggttgtcatttaaatgtgcaatatgttttatcgtaatacattgttttatatgaattagcactaattgcgaaaaattaatttatcattctgtacacatatttcgtacaagtttgctattgttacctcacttaacattgattaacatttttaacagaggcgtagcatgcatcaaaattcagtgacttcagattctgcaggagcaatcactcgttactttgcaaaagctaacttgcctactcagcaggaaactctcggggaaattgtgactgagattttgaaagatggacgtaatctgagtcgaaagtcgctttgtgccaaacttctttgccggctggaacaagcgacaggggaagaggaacagaaacattataatgcactaattgggttgctttttgaataatgcaacagcctgattatttaacaggttagctatgaagtcgttatgaagacatctgataatgaaagtataaaatatgaaattactggccaggcggtgctccagatactgcgcatgaagataaatttttcgttgcagactcttattaagcaattactcgtaatgaaatcggctgaggaaaatactttccgacgagatttaattgacagcataattcgtgattttagcaacagtgatacaggagggccaaaccgaagaacagcgatagctgacaataaaagtatgttcactggtaagaaaataaacagaatacattaaaatttcataagtaagatgagaggttaccatgcttgaagatactactattcataatgcaatatctgataaagcgttatcaagttactttcgtagttcaggtaatttgttagaagaagagtctgctgtgttagggcaggctgtgaccaatttaatgctttcaggcgataatgttaataataaaaatattatcttaagtctgatacactccctggaaacaacaagtgatattctcaaagctgatgtgattagaaaaacactggaaatcgtgttgcgatacacagctgatgatatgtaacttttaattataaagtataagtttatagaaaactcattcatcttatttttgtctgtcgctttagactatacacagcataattttattggatcactattcctgcgaggctgacatgaataattcaatcccagagagatttatttttcaatgtgctttgtttaaaaatctcgagagggaggtgttcatgacacatggatatgttgatagtcatattattgctcaggctttacgcttgcgtttaaaagatgagaccagtgttattctttctgatctctatctgcaaatcttgcagtacattgaaatgcataagactacactaacggatatcattattaatgacagggaatctgtgctctcttaaaacttgagtaaggtttttgaataaacatcagctgtatcactatgctgatgcaaagtgagcatttcaggcgttatgctttcttaatatatccgcaatatcagagggcaaacaggaatggagagcgctcgttttccattcttgacgcctgatatcccgcctaatttgtttaattctgcctacattgtgctaaaaaattaataggctagatgaagttggagaaaattttatcttcggcgtggatatttgtgatgctctctaccatgctctctgtagaccccagcgcgagcgaatgaacgtctctttagcttctacagacttatcgataaaggctttgggattttgatatttattctgttaatcgcctgcgccgctgcctttctgcttgataggtatttcaataaaagcgcaacgcctgaagagatcctgcgacgggctataaataatggggagatcgtccctttttaccaacctgtggtaaatggtcgggaagggacattgcggggagttgaggtgttagcccgctggaaacaacctcacggtggatatatatcacccgcggcatttattccacttgctgaaaaatgcggattaatcgttccgcttacgcaaagcctgatgaatcaggttgccagacagatgaacgctatcgcgagtaaactgccggaaggttttcatattgggattaattttagcgcctcgcatattatttcgccgacgtttgtcgacgagtgcttaaattaccgtgacagttttacccgccgcgatttaaaccttgttctggaagtcaccgagcgtgagccattaaatgttgatgaaagtctggttcagcggttgaacattctgcatgaaaatggttttgtcatcgcgctggatgatttcggtactggttactcagggctttcttatctgcatgacttgcatattgattatatcaaaattgatcatagtttcgttggccgcgtcaacgcagacccagcatcaacccgaattctggattgtgtattggatctggcgcgtaaactttcgatcagtatcgtcgctgaagatgtcgaaacgaaagaacaatttgactatctgaaccaaaataatatcacatttcagcagggttattatttctataaacctgttacatacatcgacctggtcaagattatcctttctaaaccgaaggtgaagattgtggttgagtgaaaattgatcagcaaggccatggtgcggtgtaattatagacagctaattagctcgttgcctcttgttactattgttcattcttttgtttgctataattgtgtgaaagttttgactggattgccattagtagcatgaacaatagtaataatctggattatttcactctctatatcatcttttccattgcatttatgctgatcactctcctggtcatccttattgcaaaacccagcaccgggctgggagaagtgcttgtgacgataaatttgcttaatgccctggtttggctggcgatcaatctggttaatcgattaagggaaagactcgtcagccacagggatcagcactaatctttcagtttctcactgccagtatgcggctgaatgggttgctggcagtgaacccctggatcattgaaggaaaggaattattgcacaaatagttgtcaaccctggtgttatcacagttgttttatatatcagtgaaataatttccatggcaactgttgataattttgatgtcgaagagttatttgttaaacaaaatagttaccccaaagtgatcaatgtcatgaaaataagctaaaaatgataatgctggcttatttattatttaaatattgtcgctgtttatctatttaaatttcttgtgcttttgtttttatctttgccttccgttttggtaatctgaactcataggttatttgagcaggaatgtttgttaatccaatgaatggatggttaatctatgaaactgaaaaaactccccggatttagtttaggacttattgctctggcggtgggtaatgcatatgtaacacaattgttggatatttatagtataatttcctatataaccgatgaagaatcaccgattgaaatcaaaaataatacttctacaagtaatggggagtatctaatcacttaagacgaaagccatgctgtgaaagtggatgacggtgtaactggatatatacataatgccagtgtgatgactagtggtgatggatcttatggtatttctgttgatagccaaaacaaagtattatatataagcgatagcaatattaagacgctctgaaagcgtatctgacaaagaaaatggagggataacagccagcgcagtagtcagtgaatttggtggcaccatcgttatgaatggtgataattcagtcgagacgagggggcatattcagcgggacttttaagtcaggttaatgattctgggactgtggaaaataacaccagtcttgaaaccacagataaaacgaacattgttacctatgggaaaaatgcagtaggagttcttgcatgttcaagtcctggagagtctcgaacatgtgtcgatgctgtagatgatgaagtttgtgattctaacagttacgaagttattagccgtgctgatttaaaaatgaatggtggttccataacaactaatggtattaatagctatggtgcttatgctaatgggaaaaaagcatatattaatttagattatgtggtacttgaaactgtggctgatggaagttatgcagttgctattcgacaaggtaacattgatataaaaaagttctattacaacaaatggcactaaagcccccattgcaaaaatatacaatggtagagagttatttttttccaatgtcacttcagaatcaacagaaacgtctacccccgtcctgcgacccgaagctggcagttacgtcgccaacctggcagccgctaacactctttttgttatgcgtctgaacgatcgtgcaggtgaaacgcgttacatcgatcctgtaactgaacaggagcgttcaagccgattttggctacgtcaaattggcgggcataatgcctggcgtgacagcaacggacagttgagaacgacctcggcacaggccatctggatgggcgtcgatcataatgtgcacacggaagccaatggctcacgtattgagaatgacgcaaataacaacattcagatccgacttggtttccgcaccttaattcgtactcaggagaaaaacagcggtccgcacggtgacgactttgaaccttttgttgaaatgaacgggatccataacagtaaagattttgctgtctcaataaacggtgtgaaagttgaacaagacggggcgcgtaatctgggggaaatgaaacatggcgtaaatggcaatctgaatccggcggccagcgtctggggtaatgtgggcgtgcagctgggtgataatggctacaatgacaccgcaatgatggtgggcctgaaatataagttctgatcccgcccgttagctaaaaaaccgcgtcgaattcatcgacgcggtaacatatgaaatattattttttgccgatagcacgcatggtgtcatcaattgccgtgatcaacagcatttgcggatctttagcgcaaacctgattcagtttttctaccactttggcgctcagttccggagattgctcaatttttaaatcacggctggcaacgctggcattacccattaccgcaacaatttctgcaacctgtgcgctgtcagtttttgccatttcgttggcttctgcgcaagtaatataggtttctgatggcaaaccgttcttaatattgtagtcctgcgcccaggtcattggtgcgaaaacaaacagacccgccagtaaagcaaattttttcatcatcattccttatttcattttacccagaattgcaccacccgtaccgccaatcacggcacctttaatcgccccttcgaggccattgccggtcagaacgccagtgacagcaccaacggcggcacccacttttgcacctttacgcgcatttttaccatcgcggcctttttctgttactgcaccaacaccagcgccaacagctgcacctttcagtacgccattaacaccattgccagtaagtaaaccaacgcctgcgcctagcaatgcacctttcgtggtgcgattcatatccgccatcgctggcgtggagcagaacaatgctgagataagcccgaaggcaagtatttttttcttcaacttagttgtccggtattaagtaagttgcacacacaataatttcgtcttcaattaagatctgcttaactaaagaacgctcgctattattcagataattcaaaatgagcgtgactgtgatgataggaattatgttttttacgggaatgagaataatctcaaatgagaaataactcattgattgacaatatttttattcaagaagtgtcattgactgttaacgcaatgttgtaaaggtaagataatctgatttatcaatattattgtgtgattgttatgtgagcagaagatattcattagcaacgattacattagtcattttattttgtggacggcctcattgtcgaaaaataagcgtacgacagtattatcagaaaagagtgattttttatccaacaacacttcagcgcactgcgtttaaaaaatacctctttcttatacgggatatcatcatttcatcatgatgtctttgatgagcggtgaacacaatacatttgcgctgtctcttcaggatgaatcccctggtctggttcctgcgggctgatgttgcagcagagctaaggtcacttagacgctactatcatttatccaatgcatggaatcgaaatcagtcgatacccgcagtatatatcgtgaactgggcgcaacgctgagttacaacatgcgtctggggaacggtatggaaattgaaccctggctgaaggcggctgtgcgcaaagaatttgtcgatgataatcgagtgaaagtgaatagtgacggtaattttatcaatgatttgtcgggtagacgtggaatataccaggcaggtattaaagcctcattcagcagtacgttaagcgggcatctcggggtggggtatagccgtggtgccggtgtggagtccccgtggaatgcggtggtcggtgtgaactggtcgttctgaccatcaacgattaaactgcgtttcggcgctgtttttgtttaccgggtgctaaaagggaaaattctggggcaaaaaaaagcccgtcagttacggcgggaaacctcatcctatgggagaacaatgaataatgaaattgcggggttatcatctcccaggatatccacgctaacaataaggttatttactcaaccaggcgtaaacattttgttctgtgcgtgggaacagccttaaggtgtaaagggggagggggaaatagcaatgaatagtatcagcaagaatactcgccgctttaccacaacgtggatgagagggatgaaaaactcaaggcagagatgactctgccttgaagataaatgcgcttttacagggggcttatttcagctcttctgcttccggtaaggtcacgttcagctcaagaatagaaatatcgccatctttttgctcaagctgtacggttaccatctcaggatcaatttgtacatatttacaaatgacctcaagaatatctttacgcaactgcggcagataatgcggttctgcatcgctgcgacggcgttcagcaacaataatctgcaaccgttcttttgcaatgttggctgtgtttttcttccgcgagagaaagaaatcgagtaatgccataacttatcctccgaacaagcgtttgaggaagcctttcttctcttcttcaatgaagcggaaaggacgttcttctcccaacagacgttctacggtatctgcgtaggctttacccgcatcggcgttaatgtcgagaatgaccggttcaccctggttagaggcgcgcaatactgattgatcctctgggatcacgccgacgagtttgatgcgcaggatctccagcacatcttccatgctcagcatgtcacctctgcttacgcggcctgggttatagcgcgttaacagcaggtgctctttaatcggctcttcgccattttctgcgcggcgtgatttcgacgccagaatgcctaaaatacggtcagagtcgcgtactgaggagacttccggattggtggtaataatggcttcgtctgcaaaatagagtgccattaacgcaccggtttcaatccctgccggggagtcacaaacgataaattcaaaatccatcgctttcagatcatcaagaactttggcgaccccttcacgggtgagggcatctttatcgcgagtttgcgatgccggaagaatatagagattttcagtacgtttatctttaattaacgcctggtttagcgttgcatcgccctgaatgacgttgacgaaatcgtaaacgacccggcgttcacaacccataatcaggtcgagattacgcaggccgatatcaaaatctatcacgacagttttctttcccttctgggccaaaccagtggcgatggccgcgctggaggttgtcttaccaacaccccctttgcccgaagtaacaacaataatgcgtgccatagaaattccttgttaaaaagggatcaatttaacggttgaacggtcaaagcgttttcgactaactgcagtcgtgccgctttgccataaaattctgctgggatttgatcactcagccagtattcacctgcgatggacaccagttccgccatcaggttcgtacaaaatatttgcgtttcccggtcaccacttgcccctgccagcgcacgaccgcgcatcatgccatagacatgaatgttaccatcggcaatcaattcggccccagcgctaacgtggcttgtaacaatcagatcacattgtggagcataaatacgctgaccggaacgcactggggtatcaattaaacgcgtttttgtgaccggcgttgtattttgcgctggagcctgcggtgcgggggctggacgcggcgatttttcctttccttccgtcaggataggcagccccatcttttcaatttcggctttaagttgcgcatctttgcagccacttacgccaataacccgcaaaccagttgccgaaaccgccttatgcatcgccgaccagtttaccgggtcttccagtgcactgacgttgagtacaacgggggcatgttttaaaaatgcgggggcctgagcgattttgtcttccagcgcctgatggataaccttaggttctgcctcatgcagatgaaccacagataaagtgaagctactgcctttaagctcgattggcgtgtttgacatcctggccttactcaattagctattaatcatcgccagcgcgcgatgatgttccgaagactataaggcatgttatagtctggattatattgaggcaagtcaccctcccatttattcagagtaaaagtctattctgtgataaatggcgctgattcatagcttaaaaaatacccttgtcaatcaacccattgccgtcgtacttttgattgttcttatttacgcttcctttttccgcaccctaatcgtgacagcatcttcagacctgtttaaatatccagtgttgaggcgagtgtattttttcaccacgccaggctttcttaactttccattttttgcagcatcattaaagaacagatacccgttatcttaatatccgccacagaattgctctatcatagaaaccgcagaagacgtctgatacttctgtcaggtcatcgtaactcgtccaggtcagcggttttgattacggattgatgatgaaatgagcataagtgttgtacggttggattatcaggatgtgctatgaatatgatgcgtattttttatatcggattgtcaggtgtggggatgatgttctcatcaatggcgtctggaaatgacgctggcgggcttcaatctcctgcgtgtggcgttgtttgcgacccgtatatttgtgtgagttcagatggcatttccccagagttaacaaggaaatatctcggcgaaaaagccgctgaaaacttacaatcattacaaggctacgatcccagcgaatttacattctctaacggtgtattttgcgatgttaaagaaaaattatgtcgtgatgatcgttattttggtgtggatggtaagcggagtggaaaaatcaatcaaaccaccacaaagatgttatttatgtgtcgtgagtgatgtcttgtttacattatgttctattcggcattgtctgctattcgtcattaacctcttgagcgacagagaggagtggggcgttaacgtttatgacggggagagtccccgtcggttgacatttacttaatttgaatatcgacgttatattttttagttttgtttttacgggcgtcgtttcgggtttgcagcactcgcagctcatatttgccagaagcagggagtgagtattgtccgtgactatcgagttctggggaatatctggataaatcaacagaatcatcgattcttggcccgaagaggtaagtatcagcgccttcattagagatactcacgtgcactttctgaccttttttggcatagaaggtatatgtatcgtaatcgtatccctttatttcgccggagtactgagcgctgctatggccttttctgaactcaacattgacattcttacccgcagcaaagctcgtggaggttagcagtgcaagcaacaatacagccttactgatgcccttaattttcattggtagtctcctgttcagaatgagtacgatgaactgttataatataacaatccttcacgggagaattccagtggctttcctgtgttcggttaaatcccggcgcggcatttttgccggggggattacttataaagggggcatggactgaacaaaccgtagaaatctacagctggctggcttgtggcgcgggtttcattgatgttagcttatgccaaaacctggcatcttaaagagtaaaagtatgttttgtgtgatttatcgaagcagcaagcgtgaccagacctatttatatgtcgaaaaaaaagacgatttttcgcgtgttcctgaggaactgatgaaaggttttggtcagcctcagttagcgatgattcttccgctggatgggcggaagaaactggtcaatgccgatattgaaaaggttaaacaggcattaaccgagcaaggttactatttgcagttaccgccaccacccgaagatttgctgaagcaacatctttccgtcatggggcagaaaacagacgacacgaacaaataaccgatatccggcggtggcattatctttgtcggcgcgggttttcatatccacgataaggtgaggggaacgttatgtatcaacatcacaactggcaaggtgcgctgctggattatccggtgagtaaagtagtctgtgttggcagtaactatgccaaacatattaaagagatgggcagcgcagtacccgaagagccagtgctgtttattaaaccagaaacggcactgtgcgatctgcggcagccattggcgatcccatccgatttcggttcagttcatcatgaagtcgaactggcggtgttgattggcgcgacgctgcgtcaggctacggaagagcatgtccgcaaagccattgccggttacggcgtggcgctcgatctgacattgcgtgatgttcagggaaaaatgaagaaagccgggcagccgtgggaaaaggccaaagcgtttgataactcttgtccgctttccgggtttattcccgcggcggagtttaccggcgacccgcaaaatacaacgctgggcctgagcgtaaacggcgagcaacgccagcaaggtacgactgcggacatgatccataaaatcgttccgctgatcgcttatatgagcaagttttttaccctcaaggccggtgacgttgtgctgacaggcacgcctgatggtgtcggcccgttgcaaagcggtgatgagctgacagtcactttcgatgggcattctttgacaactcgcgttttgtaatactttttgccgcctgaaagcggcggcaaaacttgcatcgctgtgccagactggttataaggtgcgttttaacgtaatggcggaacacctgatgagcgatgtacctttctggcaaagtaaaaccctggacgaaatgagcgatgcggaatgggagtcgttgtgtgatggttgcggtcagtgttgcctgcataaactgatggatgaagacaccgacgaaatctacttcactaacatcgcctgtcgccagctcaatattaaaacctgtcaatgtcggaactacgaacgtcgtttcgagtttgaacccgactgcattaaattaacccgtgaaaatctgccaacattcgaatggctgccaatgacctgcgcttatcgtttgctggcggaaggtaaaggtttacctgcgtggcatccgctacttactggttcgaaagcggcaatgcatggtgaacgtatctctgtgcgtcatatcgcagtaaaagaatcagaagtgattgactggcaggatcatatcttaaataaacctgactgggcgcagtgataaatttaatagatgttgatgggggctttcttaatatacgtctggatgctcgccatttcgtagccctgtttttgaaagcgctctgtcataatgagagttacccgataccttattatcaacaggtaactctcaatctttaaaaaacgtctgtatttttaaatgtgataaactttataccttgagtacatagagagaataatcgcttatcagacttcaggtatctcaaagagtgtcttcttaccgtgtcttttctgatactcattacaggtgttaatcattttttgggccgcttcttttagtaaagaaagcattaaatcatcataatcaacgtagaatctggttgtttcagtttcagtttccgtttttatcaccccgatggcggctatttcggtagttaatttcaatttggcggcatcgatatctttattcgcttgtttaaccgtgttagacagggtggtaaagaaactcagcgcagattttaacttgttcttcaattctggaatcagtttcccttcaactacgcccgcagcaatagaacacagtttcttgatgccgtcatccagtaccttaatgagaatgcctttctgggcgaatgcttcgattctattttaaaccaggtgatatttttcctttctgctggatggacgctgtcgcaagaaggccgcgtgagcacaggataagagaacgaaaaatcagcagtctatgcagcgacaaatattgatagcctgaatcagtattgatctgctgacaagaacagactactgtatataaaaacagtataacttcaggcagattattatgttgtttatcaagcctgcggatctccgcgaaattgtgacttttccgctatttagcgatcttgttcagtgtggctttccttcaccggccgcagattacgttgaacagcgcatcgatctgaatcaactgttgatccagcatcccagcgcgacttatttcgtcaaagcaagtggtgattctatgattgatggtgggattagtgacggtgatttactgattgtcgatagcgctattaccgccagccatggtgatattatcatcgctgctgttgacggcgagtttacggtgaaaaaattgcaactacgcccgacggtacagcttattcctatgaacagtgcgtactcgcccattaccatcagtagcgaagatacgctggatgtctttggtgtggtgatccacgtcgttaaggcgatgcgctgatgtttgccctctgtgatgtaaacgcgttttatgccagctgtgagacggtgtttcgccctgatttatggggtaaaccggtggttgtgctatcgaataacgacggttgcgttatcgcccgaaacgcaaaggcgctgggcgttaaaatgggcgatccctggttcaaacaaaaagatctgtttcgtcgctgtggcgtggtttgctttagcagcaattatgagctttacgcagacatgagtaatcgggtgatgtcgacgctggaagaactatcgccccgcgtcgagatttacagtattgatgaggcattctgcgatctgacaggtgtgcataattgtcgcgatctgactgattttggcagagaaatttgcgcaacggtgctacaacgtacccatcttactgttggtgtggggatcgcccagaccaaaacgctggctaagcttgccaatcatgcggcaaaaaaatggcagcggcagacgggcggggtggtggatttatcaaatctggaacgccagcgtaaattaatgtctgctctccccgtggatgaagtctgggggattggacggcggatcagcaaaaaactggacgcgatggggatcaaaaccgttctcgatttggcggattcagatatccggtttatccgtaaacattttaatgtcgtgctcgaaagaacggtgcgtgaactgcgcggtgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgttcaatgaaccttattacggcaatagcgcatcggtaaaactgctgacgcccactcaggacagcagggatatcattaacgccgctacgcgatctctggatgccatctggcaagcgggccatcgctaccaaaaagcgggcgtgatgctgggggatttcttcagtcagggagtcgcgcagctcaatttattcgatgacaacgcaccgcgccccgggagtgagcaattgatggcggtaatggatacgctgaatgctaaagagggcagaggaacactctattttgccgggcaggggatccagcaacaatggcagatgaagcgtgccatgctttcaccatgttatacaacgcgaagttctgatttactgcgggtcaaataaacatagcggcaggaaaaagcgctcccgcaggagcgccgaatggattagcgaccgaacaggtcacgttttttcgctttaaacggctgggaaatcaccaccagcaccgcgacaatcaggtaagtgataaaaataccgagcagccactgcggcatttccagacctaaaaattcccactgacgctcggcgcaatcgccagaggcgacaaacacttgcggcacccatttatccagcggcagccattccgggaaacgagccataaaatcacaggtcgcaaacggcgaaggatagagctgaagcatggtgtgctcgtaagttaactgcacaccgcggaacgcactatacaaccagataaccatcgctacataacgcagcggagttttcggggcgatcgcgccaatcagcgcagcacccagaacgccgaataacgcgcagcgttcataaatacagagcacgcaaggtttcagtaacatcacatgctggaaccacagcgccgtcagttccagtgccagagcagtaaacgccatcaacagccatgcaccccggccttgtgaacattggttcaaaaatcgcaacataatcatttccctgcaatatgcatagagtgcgcagtttaaaccaattcattcgctgcgccaccaggaggcagcaaaaataggacgcaattggacaattatcgggcgaaaaggcaaaccgggcatttatatgcccggtaagttgttatcaaagcgttgctatccagcccatttgcataaaccattcggttacaggagcaagcgtaaactcgacgcagagcagcccgacgagtgtcaggacgagggtgtaaggcagggccatccacaccatgcggccataagagagacgaatcaatggcgcgagtgcagaggtcagcaggaacaggaacgcagcctgaccgttcggcgtagcgacggagggcagattggtaccggtattaatggcgaccgccagcagctcatattgcttcaacgtgatagcgccacttttcattgccgctttcgcttcgttgatataaatcgtccccacgaagacgttatccgaaatggatgacagcagaccgttgaaaatatagaacaacgacagctgagcatgttcagatgcctgcaacacaaactgaataatcggcgaaaacagttgttggtcgataatcaccgcgactactgagaaaaacaccgtcaacagtgcggtgaatggcagagattcggtgaaggctttaccgatagcatgttcatcggtaacaccggtcaatgatgtcgccagaataatgaccgacaaaccaatcaaaccgacttctgccagatgtagtgccagcgcggtgaccagccagacgccgataatcgcctgcacaatcagacgaattttgtcctgacgtgtacgctggagacggctttgatcgtcaaactgttgcagcacttcgcggactttctccggcagcgtttcaccgtagccaaaccaacgcagcttctctaccagcaggcaggttaacaggccacaaatcagaaccgggacggtcaccggcgacatgcgcaggaagaaatcgccaaaatgccagccagccgctttagcgatgatcaggttttgtggttcgcccaccatggtcatcacgccgcctaatgcggtgccgacaccggcatgcatcatcagactacgcagaaagccacggaactgttccagaaccactttgtaatgcttgtcgatatgactatcgtcttgcaggtcggtatcttcagtacgggaagaggctacgcggtgataaataccataaaaaccgactgcaacgctgatcaccaccgccacgacggttaaggcatcgaggaacgcggagaggaacgccgccgccacgcaaaaagagagcgacagcagcattttggagcgaatacttaacagcaaacgggtaaatatgaacaacaacagctgtttcataaaatagatacccgccaccataaacatcagtaacagcaagacttcaagatttgccgccacttcttcacgaacatgttccgcgctggtcatgccgatgaataccgcttcgatagccaacagaccaccggggagcagcgggtagcatttcagggccatcgccagagtgaaaataaattccgctaccagcaaccagccagcgacgaaagggctgatgaggaaaattaacggatttacgattaagaaaatgatgagggcgagtttgtaccagtcgggggactggcccaaaaaattgcgccatagtgcgcggccccaggagatctccatgatggtttcccttaccttagaaataatcaatgatgtttttatgtttaaacgcaaagcttaacggtcagacaggagtgaggcaagtcttgatagtcaaggggaaagagatgcagaaaatgaagccttgatcccttttttcttctttttgtcttctatcagcgtagttagccctctggtatgatgagtccaactttgttttgctgtgttatggaaatctcactatggtcattaaggcgcaaagcccggcgggtttcgcggaagagtacattattgaaagtatctggaataaccgcttccctcccgggactattttgcccgcagaacgtgaactttcagaattaattggcgtaacgcgtactacgttacgtgaagtgttacaacgtctggcacgagatggctggttgaccattcaacacggcaagccgacgaaggtgaataatttctgggaaacctctggtttaaatatccttgaaacactggcgcgactggaccacgaaagtgtgccgcaacttattgataatttgctgtcggtgcgtaccaatatttcaactatttttattcgcaccgcgtttcgtcaacatcccgataaagcgcaggaagtgctggcaaccgctaatgaagtggccgatcacgccgacgcctttgccgagctggattacaacattttccgcggcctggcgtttgcttccggcaacccgatttacggtctgatccttaacgggatgaaagggctgtatacgcgcattggtcgtcactatttcgccaatccggaagcgcgcagtctggcgctgggcttctatcacaaactgtcggcgttgtgcagtgaaggcgcacacgatcaggtatatgaaacagtgcgtcgctatgggcatgagagtggcgagatttggcaccggatgcagaaaaatctgccgggtgatttagccattcagggacgataatccttccagacggatgacaaacgtataattgcctgatgcgctacgcttatcaggcctacgtgtttttttgcaatgtattgaatttgcgatactttgtaggccggataaggcatttacgccgcatccggcaaaaatgagtcctcctcaaacgaggaggactatttacagatttcccattctcggcgggcaacgttccagcaactcgacgctgccgtcttcgttttgctgttccagcatcacatcaaatccccacaggcgatgcacatgcttcagcacttctttgcgcccccgatccagcggtgcgcgattatgtggaatgtaacgcagcgtcagcgaacggtcgccgcgcaaatccacgttccagatctgaatattcggctccagattacttaagttatattgcgacgataaccggttacggatttcccgataaccttcttcattatgaatagcggaaatctccagataattatgccgatcatcatccagcacggtgaagaagcggaaatcacgcatcactttcggtgacaggaactggctgataaaactctcatctttgaaatcacgcatcgcgaaatgcagcgtttccagccagtcggaaccggcgatatccgggaaccagtatttgtcttcttccgttggtgactgacaaatccgtttaatatcctggaacatggcaaacccgagggcatacgggttgatgccgctgtaccacgggctgttatagggcggctggaagactacattggtgtggctgtgcaaaaactccagcataaaacgttccgttactttcccttcatcatacagatggttaaggatggtgtagtgccagaaggtcgcccagccttcgttcatcacctgagtctgtttttgcggataaaaatactggctcaccttacgcacaatacgcaggatttcacgctgccatgattccagcagtggcgcatttttctccataaaatagagcaggttttcttgtggttcggacgaatagcggcgcgcttcagcaaccgttttctcttcctcgcgcttcggcagggtacgccagagcatattgacctgactttgcagatactcttcgcgactcttctgccgggctttctcttcttgcagcgagattttttgcgggcgtttgtaccggtccacgccgtagttcatcagcgcgtggcacgagtccagaagccgttctacttcatcaacgccataacgctcttcgcactcggtaatatatttacgggcaaaaatcagataatcgacaatcgaactggcgtcggtccagctacggaataagtaattgtttttgaagaaagagttatgcccatagcaggcatgagccatcaccagcgcttgcatggtaatggtgttctcttccatcaggtaagcgatacacgggttagagttaatgacgatttcataggccagtccttgctgaccgtgcttatacagccgttcagtctcgataaactttttaccgaatgaccagtgcggatagttaattggcatgccgacgctggagtaggcatccatcatctgttctgaggttatcacttcaatctggtgcgggtaggtatccagccggtagagtttcgccacccggtctatctctgccagataaacatccagcaggtcgaacgtccagtcgggtccatcgctcaaacgtgtggtgtccttattcatagaatcgatcgtcgccatacgcgcacctcattgttgtcggcgctctctgtgtggagcacctcatttcaagcatagaacacctgttaaaaaccgcgtcgccggagaatttttttctttgcgatttcttattatcagagtgccactaatccgcttctgaacggaattttatgctggataaaaagggcgttcagcaggagatactaaagacgccatattgccgcagagtcagggagatgtgagccagctcaccataaaaaagctgtatgttgaataatattttcaactgagttatcaagatgtaattagattattgttcttttactgtatctaccgttatcggagtggctatgcgagttgtcatactgggaagtggtgtggtaggcgttgccagcgcctggtacttaaatcaggcaggacatgaggtcaccgtcattgatcgggagccgggggccgccctggaaaccagtgccgcgaatgcagggcaaatctcccccggatatgctgcaccgtgggcggcaccaggtgtgcctttaaaagcgattaaatggatgttccagcgccatgcgccgctggcggttcgtctcgacggtacgcagttccagttgaaatggatgtggcaaatgttacgtaactgcgacaccagccactatatggaaaacaaagggcggatggtgcgtctggcggaatacagccgtgattgcctgaaagcattgcgcgccgaaaccaatattcagtatgaagggcgtcagggtgggacgctgcaactgttccgtaccgaacaacagtatgaaaacgcgacccgcgatatcgccgtgctggaagatgccggcgtaccgtatcagctgctggaatccagccgcctggcggaagtggagcccgcgctggcagaagtggcgcacaaactgacgggcggcctgcaactgcccaatgatgaaaccggagactgccagctgtttacccagaatctggcgcggatggcggagcaggcgggggttaaattccgctttaatacgcccgttgaccaactgctttgcgacggcgagcaaatctacggcgtgaagtgtggtgatgaagtgattaaggccgatgcgtatgtgatggcgtttggttcttactcgacggcgatgctcaaaggcattgttgatattccggtgtatccgctgaaaggctactcgctgactattccgattgcgcaggaagatggtgcgccggtgtctactatccttgatgaaacctacaaaatcgccattacccgtttcgataaccgcattcgtgttggcggaatggcggaaattgttggctttaacaccgagctgttgcaaccgcgtcgtgaaacgctggagatggtggttcgcgatctctatccacgcggcggtcatgttgagcaggcgactttctggactggcctgcgcccgatgacgccagacggcacgccggttgtcgggcgtacacgctttaaaaatctgtggctgaataccggtcacggcacgctcggctggacgatggcttgcggttccggtcagttgttaagcgatctgctctcggggcgcacgccagcgatcccgtatgaagatctaagcgtagcgcgctacagccgtggatttacgccattacgcccgggccatttacatggcgcacacagctaaggaaacgagatgacccgtccgatacaggccagcctcgatctgcaggcattaaaacagaatctgtccattgtccgccaggccgcgccgcgcgcgcgcgtctggtcggtggtaaaagcgaacgcttacgggcacggtattgagcgtatctggagcgcgatcggggctaccgatggctttgcattgcttaacctggaagaggcaataacgttacgtgagcgcggctggaaaggaccgatcctgatgctggaaggatttttccatgctcaggatctggagatttatgaccagcaccgcctgaccacctgcgtacacagcaactggcagctcaaagcactgcaaaatgcgcggctaaaagcaccgttggatatttatcttaaagtgaacagtgggatgaatcggttgggcttccagcccgatcgcgtgcttaccgtctggcagcagttgcgggcgatggcgaatgttggcgaaatgaccctgatgtcgcattttgccgaggcggaacatcctgatggaatttccagcgcgatggcgcgtattgagcaggcggcggaagggctggagtgtcggcgttcgttgtccaattcggcggcgactctgtggcacccggaagcgcattttgactgggttcggcctggcattattttgtatggcgcttcgccgtccggtcagtggcgtgatatcgccaataccggattacgtccggtgatgacgctaagcagtgagattattagtgtccagacgctaaaagcgggcgagcgtgtgggctacggcggtcgctatactgcgcgcgatgaacagcgaataggcattgtcgccgcaggatacgccgacggttatccgcgccacgcgcctaccggtacccctgttttagtggacggcgttcgcaccatgacggtggggacagtctcgatggatatgctggcggtcgatttaacgccttgcccgcaagcgggtattggtacgccagttgagctgtggggcaaggagatcaaaattgatgatgtcgccgccgctgccggaacggtaggctatgagttgatgtgcgcgctggcgttacgcgtcccggttgtgacggtgtaacttgttatcgctggatgcgaccagcgtcgtatccagcgttataaaacacattaaacttaagattcggcttcttcctccgctacccgaacaccaatcttcaacacttcattatcttctttctcggccaccgtccagatcatcccggcaaactctacctggtcaccgacaaccggtgctgcgcctaacaactgctggacgatttcacccagcgtttgctgcttatcgcgatattctcgcccgtcttccaggccatatatcagcgccacatcagcatatttggcgctggcttcgagaatgaagtcaccaaagaagcgttgatccagcgcgaccggcggcgactggctgaacagtttaccgagcgccgggagatcgcgttcccgaccaattacacacaacacatcgccttcgcgcagtcgggtgctgccggtgggatgaagcaactggttatcacgaaacagtgccgcaatacgcgtctcttttggcatatgcaaatcacgcagtgccgcgcctacgcaccatttatcggcactcaattgataaacaaactgctcccacggattttccggatgaatatccaggccaacgcgtgacaccggacgtcccactggcggaacgaccactttggcttttttcgccgcccacgagagtgatgttccctgcaatagcagtgaaaccaggaccacaaagaaggcgacattaaagaacagtcgcgcattctccagccccgccatcatcgggaacacagccagaataatcggcaccgcgccgcgtaatcctacccagctgataaacacgcgctcacgcagattgaagccacggaacggtagcaatccggcaaataccgaaagaggacgggcgaagaaaatcatccatgcggacaaaatgagcgccggaatggcaataggcagcagatcgcttgggttaaccaatagccccagcaccaggaacatggcgatttgcgccagccaggcgaggccgtcgaaattttgcaggatgccgtagcggttgcgaatcggccgattacccagcagaaaaccgcacagataaacagccagaataccgctgccttccagcgccgtggttaaagcaaaaattaaaataccgccgcttaatgccagcaatggatataatccggcgggcagggcgatgcgattaatcatttgcagcagtaaataaccaccgccaagcccgatgacaatcccgaggccaaattgctgcagaatatcgaccacgaacatccaactgacactgctttcatgctgctggatcatcgcaatcagggtaatcgtcagaaagaccgccattggatcattactgccggattcaatttccagcgtcgagccaacacgttcgttaagccccttaccacccagcagagaaaagaccgctgcagcatcggtggagccgacgatagcgccgattaataatccttcaatcaaatcaagattaaacagccacgccgccatcatgccggttaaaccagaggtgataagtacgcccagcgtcgccagcgacagtgccggtcctaacgccacacgaaaggaactggcctgagtgcgcatcccgccgtcgagcaaaataatcgccagtgccaggttacttaccatgtaggcgaagggataattatcaaacgggataccgccgacgccatcaacccccgccagcatgccgatcgccagaaaaataaccagaatgggaatgccaagacgggaagaaaatgaactaagtaaaatactgctggtgacaaggatggatcctaagatgaaaaggctaattattgttgtggcatccaacggtcggttactcctgattacgttgtctcttatataaaccctaccatattagcggcagagacagcgttttacttagccctgaagcgtgatttttttacattttaagaacaggatgaccgctaatcgtcaactgagtgccttcctgggtgttattcagaatggcatgtgcgcccaacggcagcgtaaccgtgcgttgttcatgaccaaaatcgaggccggtaatgagcggaatcgacaggcgggaacgcaaaaacgcgtacactgactccaggttgtaacctgcgtcataatcattaggcgtgctgccgctaaagctaccgagaataatcgccttctgacgtggcaaaattccagcatgatagagctgcaacagcatacgttcgacgcggaaagggtgctcgttaatatcttccagcaccagaataccgttctcaatttttggcatccacggtgtaccaatcagtgaaatcagcatcgcaagattgcctccccacagcgtgccttcggtctgacatgtcgggccttccccttgccattcaatggtgaacgttttattgcgtaacgccagccagaagtggtgctcggtaaaggcatttagttcatccgcgccaaagtttgctaccagcatggggccgctaaaggtgatgacattgccttgcgccagaagaccgcactgaatggcggtaaaatcgctatgtccgcaaatgagtaacgggtcatgttgttggcgagccaccagtgcctgccagtcaatatctgccagtaaacgactggcaccgtaaccgccgcgtacagacagcacgatggtgttgggggtagtcagtctggcaagagaattgagatcttccagacgctccgtttccgtacccgcaaaacgctcacaacgacgggcaataacctcgacgttattgacctgatgccccgcgtcggtaaggcgctggataccacgcagcgcggcgtgctgtttaatgcagtaacccgatggggcaattaagtgaaacagagacatggcaattccttgctgacaacagaaacgaaatgtatatcatgccgcttaggtgtgccgttgtcacctcaacggcgattccaggctataaggatagaagaagtgaaattgagatggtttgcctttttgattgtgttattagcgggttgttcatcaaagcatgactatacgaacccgccgtggaacgcgaaagttccggtgcaacgtgcgatgcagtggatgccaataagccagaaagccggtgcagcctggggcgtcgatccacaattgatcacggcgattatcgctatcgaatcgggtggtaatccgaacgcggtgagtaaatcgaatgccattggtttgatgcagataaaagcttcaacctccggacgtgatgtatatcgtcgtatgggctggagcggtgagccgacgaccagcgagctgaaaaatccggagcgtaatatttcaatgggggcggcttacctgaatattctggaaaccggcccgctggcaggcattgaagatccgaaggtactgcaatatgcgctggtggtgtcatacgctaacggggcaggtgcgctgctacggactttctcgtcagatcggaaaaaggcgatcagcaaaatcaacgatctggatgctgatgagttcctcgatcacgtagcgcgaaatcatcctgcgccgcaggctccgcgctatatctacaaacttgagcaggcactggacgcgatgtaaatcagtcgcgcacattgtccgcttttttccgggcttctcgctcgagagagaaaataatccgctgtaattgccgctccaccgtcgggctgacgttaagaaaacggaagctcagacggggagtggtgatggtttcatttttgccatcaatcactttgcgctcgctgatggagattaactgggcgtcaaagtgaaaaacaccccattgccccatgttgacttcaatctgagagaagcgcatgccttcgtgtaattcggcaggctttgctgtttccagtaatgcgcccatgccgcctaacgacaaatcatacaggcggaaacgtaacgtactgttatccgccagtttggtctggcaaaaataaggcggatggagtggggcggtgatgcggaaatatcggcgtcgttgtacaaaccataaggtgggaggcggtacggtaataaatgccggaagctgcaagtattcactctgctgtagttgttcaacagtaaactcgactttcgcaccctgagtttcggcggtaatggtaatgtgctgcgcctttagcacggcgatgttgtcttcggcctggctgccgaaatccagcaccagtttatccggagttattgccagtattttgctgatcagctgcccgccattccagctgatacgcaaaggaattgcggctttgtgcaaatcgcgtaacacgcccaggacggctaacggattttgtttcaggaactgctcatggtaatgactcacgcggaaaaactcctgactgacaaactgtctttggtttatcggtcgcagttaacaaaacttaatacaaatgcgcgaatattttttacatgttgttcttaaatcagccgacatacgcccagcatcgatcccgcccttgcctatacttagagcgttgacgtaagcatttcttgcgtccgattcatcgaaacgagggcctgaacatgggaattattgcctggattatttttggcctgatagccggtattatcgccaagctaatcatgccggggcgtgatggtggtggatttttcctgacctgtattcttgggatagtcggtgcggtggtcggcggctggctggcgaccatgtttggcattggcggctccatcagcggttttaatttgcacagcttcctggtggcggtggtgggcgctatcctggtgctgggcgtattccgcctcctgcgaagagaataagattttcataaggcggatagcgatacagatgccgctatccgctttcacatcagaacgtatactcgatacctgcccagaaattgcgaccttcttcaataaacccttcactgtaggcatatttggtatcaaacaggttattgaccgacgcattaacgctgaagccatgacctaaggtgtaatcggctcgaatgtgggtcaccgcaaaaccggcggctttttgtgaaccgtcactgttgctgtagctggaggaacgtgcctcttccgacagcgttacgcttaacggctcccacggtttgagagtcatccatgcggtcattgtctgcgttggcagatcggttatcttgccgatgtctttgcgtttggcatcagcgtggatcagggcgtagctcaatcctacatccagtatattgctgattttccccttaataccggcatccagaccgctgtaatccaccgtgccgctgttctgattttgaatggtatcggcatcgatattgtgcgagaggatggcatcactcacccggttatagtaaacgctgacctcaaatccccagtcgtgcgtgaaggcaccattccaggttaaatccaccccgcgcgcgcgttccggcttgagctgcgggttaacaatcgctatctggttatacgcaggtttggacgtggtatagcgttctttcagcgtcggaaagcgtgtgcggtcatagtacgaaagcgccagcgtgtcttcattggcaaagtggtatttccccatcacctgccagttaaaagctgactgatagttgtcgtcataatgggtgatactgccatctttctcatgttttttcgcttctacgctatcgcgccagtcatagctgattccagccacgacatcgacattatcggcagcagcccattgatattcactggcgagcgaccaggtacgatcttcatagcgatcgtaagcggcgtgcggcgcacctttttcccggtgtacgtcatctttccagttaacggcaaacgacagcagatcgttttcacgcacatcggctgccagttgtaacccggcaccgtcgctgtaatcggaataatggctgtagctgccttttttatttttcaaatcagccagcgagttgtacatcattagcgtattttcaaaggtgtcgcgatacagccgacttttcagggtaaaacgatcgtttagttgggtcgttccctgataataaaaactttctttgtcatactctggccactgccagtagcgtgatttctgaccactatttccactgtatggcgggttatctttttcaccatcctgcttaatgtaagtcaatgtgtattcatcgttttcgcgtggtgtaaaaccgagcttcacaatgccgcgtttatcatcagccgatgaattaatcatcttgccgtgtttgcctgcaatatcattatttacaccatgcggcaggccgagaaaatcctgctttagctggctaccgctgacttgcaaataccccagatcgctgctggcggcaaatgaagcatgcatatcgtaggcattgtcctggctacggctccatccctggcgatatcccagacttgcttccagaggttttgttggcttctgggtggtgatattaatggctccgcccatctgattaggcccctgaagcagcgacgaataccctttggaaacttcaactgcccccaaattgttggtcagaatccgcgccagatcgaggttgccgtcatagggaacataaatgggcacaccgtcgaaatagaccggcacctgacgactatcaaagccacgaactttgacctgttcttcgttgcggctacctgacttttgcagcaccacgccggggacgacacttaatgcctgagcgacattctgtttatccagggccttcatggtgggttgatcgagaacggtggtcgtcgttgatgataccggactggaccatacggtcagcgtgtcactctcctgagccgctacggactgctgggtaaaggcaagtgataatactgtgcagagataacgttttttgagtctcatagaataaattccgtttaacaaagaattaaatagaggctgcgggttgcagactgactttaatgtcagcaggtgccgcgtaataaggcgcggaggtaataaaaaggcgaatgccgcagtcgaggtaatttttgagtgttgtcagattaattccgccggtcagagccagcgtgcagtggggagccagcgacggtgctatttgcgcaatttcagttgcctgttgcggactaaatttgtcgagctgaagtacgtctggttgcgcgcgtaacgcggcgattgcctctttcggcgtgtcggcttcaacaactattttcttctcgggtgcgtggcgacgtaactgattgattgcgcctgaccagtcctgattgtcatgaagaaaatggcggtggttggcaaacaataatatggtttccgcacatccggcacgatgaatcagtcctccggcagccagaattgcctgcgaggccagtaagcgggtgcccggaattgcttttcgggtgcaggcgatattgccatcagggtaacgttcacgaagtaacgccagcatttgagcgagataatcagaaacaccgcaactccactccagcacattctggactgccttccatccctgatgaagtgctgcggcattaccttgcgcacggattagccgctgacccgcgttcgcttgtgaaccgtcgctgaccgcgtcatcaatagttaatcccagcgtagttaacatcttacacgcgacagaaattccgctgacgcagccgccctgacggagaaaaaactctatatagccatgctggtgtccaatatttaatgctcgtgtggtcaggtcaccgccctggatatcttccagcagtaacgcatcgatttgtgcctgagaaaagaaaatcatcgcagtgtctcctgcggtacgctatcccaccagatgagcgcccagtcgcggctggcaggggcgagggcacgagcatcttgttgttgataccagcgatataaccgctcacgctcatcgtcgttaagcgcgcccagactccagctgacgttctgctcaaaacgttcccaggtgctgttatcctgttggcaattttgtccgcggataaaatcaacgtgagcataaattcccatctgatacaggacgttgagcgcaaagatatagttgggtaattcgaccacttcccgaccagccgcccgctgaatggctggagagacgaacgaggtgctgaccagatgagtcgtatagacgcgaagccgtgcctgattattcagtttgctcattgcctggcgcatatcagccaccagagtggagcgggaggccacggcaatatcgcagcgtggcaggtcactccagtcctcttcccaggcgcgctggatccagtggacattgtctgcctttagcgcggcggcgcgacgggcggcaacgttcagcatcccctgactgtaatcaacgccataaatcgtcgtgagtttgtccgccagcgccagcgatacggtacccggtccgcagcccatatcgaataaggtttgcgcgccttgcaggtcaatttttgaggtcagttgttgcaggtagctgtccgtcggcgaggcgcaattttccgccattttttccgcccgttgatcccagtgatccggcgttttttctgtgcgatgggccagcctgagttgctgaaggtaaaggtctgcaaaatcaatatcgtcaatgagcatgatttttccttagtgcttaattgcagagaggtgatggtgaatctggtcggcagaaacccggtacagggcagccagttttttcgttgttaactgttcggtcggtaagccttgtgttactcgtccatctggctctacctggataatgctgtcggcaatggcgttggcatggagcggatgatgagtcgacattaacattgtcatgccgttatttttgagctgcgccagcgtgtccagaagttggatctgatgaccgaaatcgaggctggaggcaggctcatccagtaataacaagcgcggttgctggacgagtgcacgggcgattaaagccagctgacgttcaccgccgctaagcgtattccagcgtcgtgtcgccagatgcaaaatgcccagcttttccagttgctccgttgctttcaggcgttcttgcttaccgggaacggaaaaagcgcctatggtgggggccaggcccatcaacaccatatccagcacactaaaagcaaaaatgccgtcgtgcgcctgcggcacccaggcaatagcctgcgcgcgctggcgatggctgagtgtctgcacagggaggctatccagtaagatctcgccttttaataacggtataacgccaagaatggagcgcatgagtgtggttttgccgcaaccattggctcctaacagacaacaaattgttccttgcgacagggtgaaggacacgtcgcgtagcaccggatggcgggagtaacccagagacgcatgacggacggcaagcaaagtcactggcgacctccgcgtaacaacaaaaacaggaaaaacggtgcgccaacaaaagcggtcagaatgccaagtgggatttctgttgttccaatgctgcgtgccagcgtatcggtaagcaggagcagaatcgcgccagtacacattgccatgggcaacagctgctgatggttatgaccggtcaacaagcgggcaatgtgcggaacgaccaggccgacccaaccaattatgcccgctattgctaccgtgctggcggtgatgagtgtggcacagacaatcaatccaaagcgcagacgtgtcacgttcagtcccagcgaacgggcttcgtcgtcggaaagcgtgagtaaattcatgcgccagcggagaaaaaacaggggcaaggagcctatgagaatgatcggtgcagcatagcagagatcgcgtaaggtcacggtggacagcccccccagcaaccagaaggtaattgacggtaactgggtataaggatcggccagcgtttttattagcgatatccccgctccgcacaacgttcctaacgcaatgcctaccagcaccagggttaagatcggatcgtggcgggtcacccgacgcgtaatcaaccagacgcccgcgaccaccatcagcccgccgcaaaatgcgtacagctggatgtaaacaatggataatccccacaggattgccgcgcaggcaccaagtccggcaccggcggagacgcctaaaatatccggtgacactaagggattacggaacattccctgataggtggttccggcccctgccagcgccgcgcccagaaacagcgcagcaagaatacgcggcacgcggatttgccagaagacaatttgttcctgcacaggaacattttcttgacgaagaatgagcgccagcagttgctgcatatcgagatgataagccccacttacggcggcaaaagtgatactgatagctgccagcagcaaaatacatccgtttacggttctcattagctcgccaccaatttttgatagtcggcgtcactgagtgaacaatgccagaacagttgggcgtaatgctgtatgtcacttttaaactggcgattgatggcgggatccagccaggcgtgaagtctgcgtaatcccagaagacggttgattcccggcggggcatccagccagccaaagggcaggccacttaaaaataagatgcgttgttccgcaaccgctttcacgccctgccagagaggatcacgacgaataaaatctgcagtaacggcctcctgaaccagaataatatccggctgccagcgcaggagattttccatggaaacctgtgtcagaccgtggcgatcggctatttgcgcgacgttatgcaaacctaataattccgccgcctcggtatgcaacgaaccctgtaagcccgtttccagccctcgaggaccgcgcgcagcataaaagctgaggttagcggcgggtgaggtggcgaatgcctgagcttcaccaacgaagcggctggcgagattggcttgttctgcggcgcggtgctcttcgcctaacgttttgccaagcgttgttaactgttctgctgattgttccagtttcccgttaagcaataaccagggtatttgtgtctgttcgctaacctgccgtgcctgggagatccaggtttcatccgtattgccgcaatcaacgaccaaatcgggatgtaacgccataagcccttccagcgagagtgtgctggcgcgcccggcgagtcgtcccagcctggggaactggcgaatgtgctctggcaatggaattaatgcctgacgggcaaaatcaaaagaggaaaaaccgaccattttttctggcgcgacagccagcaatagtaaatcggcgggcgcgcctgcgctgacgatgcgtgtaatgttttgggcttcgggaagcgtccgtgaggcccagaatttgactgattgtgcaaaggacggcagatgatgcaggaacaatgtcgacgcaagaatctgtgtaaacctccgtctggttagtgacataagtaatatcctgataattaaaaccgctatatacttacacatatagcgaaaaagatcatgtttgatgtcaaaatttgtctaaagagacagaatgatttgcttgttgcttaaataacactttgttccacaagaaaattgtcagggagaatggggagtgggggaaaatataaatagaggtgtaatgattaacaagttgataaaataaaattaaactcttctctaataaaagaaaataaaggcatagaccgtagaaagagtggtatttggtatttcgtgatgaagaaagagcaatgccaattttatgcacgtaatggcattgctcgatatacagtaaagttaaggcgtaggttccgcctctttttgttttagcggctgtgttgttgattcactgagtggacgcgtcgccggaacattgtcacacggttgctctttcgggcagatcaaatccagcattttcagcgtcacgccattggtccagccaaagccatcctgtaatggatattcgccaccgccgccccctgttccggtggtgctgacatcatatttttccaccagctttttctcccggtcataggtgtgctgaacattggtcaggaagtgccagctaatgtccatcgctacctctttttgcccgtagttttgtaatccttctgtcgcgacccactgcaacggtgcccagccgtttggcgcatcccattgttgcccacttttcaccgacgtggtgttcaggccgcctggttgcagcagatgtgttttcgtcgccgtcgccattttgctggcgcgatctttcgctgccgcattgacgtacagcgggaacagggcggccgcggttaactgattgcgcactttatgacttttcaggtcgtaatcggcataccagccttgttgatcgttccacaggtatttttcgatccctttttgacgggcatttgccagcgtttcgtactggtttgccatcgcgttatctccggcagctttgctggcgcgggagaggattttttccattttgaacatcaagctgttcagatcgaccggtacgatgctggtggtgcgtaaggtgtttaactgctgcggattgtccatccagcgcgagctgaaatcccagccagacgcagcggcagagcgcaggtcgcggtaaatttcagtggcaggtcgattcggattgcttttggcagtggcaatatcttccacccatgactctggtcgtggcgtatcgcgatcgtcccagtagcggttgagaagggtaccatcctgaagttttacaacgcgtttttcctgttgtccggcttgcaggttttcaacaccgtccatccagtaagcatattctttttgcatttgcggcaggtattgtttcaacgcggcgtcgccttcatgctgcgccagtaactctaccatcagggcaaagaagggcggctgcgagcggcttaaatagtaactgcggttgccgttgggaatatgaccgtaagtgtctatttcatgagcaaaattggctaccatatccgcgactttatcccagtgaccgctttcggcaagtcctaacatggtgaagtaactgtcccagtaatatacctcgcgaaaacgtccgccgggcacgacataaggttttggcagcggtaatagagaatcccatttttcggtgttttcggtagaacgcgttaataccggctaaagtccgtcaatatgttcgcgcagtgattgcccctctggcggaacatatttctcgccctctttcggcagggtgaaattgacgttaacgaaatggcgtagatcaaatccgctctggttttgctgcatccgataatcagcaaggatcatcagcggatcgctgttcggcacggcatcggcaaaggttttttggtccggaaaaagtttggcgttttgcacatcattaaacagcggccctaataaaatatcaggcggttgtggtgttaccgatgtttcttctgcctgcaccgatagcgcagcgaaacacaaaaagatgcaggctggaattaacgccattttttgcgggcgagaaggtgcgggggatttcatcagtcattctcctttggcgaaaccgaataaaacggtattcaagtatcagaaaaccttagttcaggatcgcactagctgcatgatcgaaatcacattctgcgaactgacagacattttagaaaagggaattaaagggataaataacggcgaaatagagtgataaaataacatctgtttattagtcagccagcgacgttgggtttgcgattagcgaagaaaaatcatcataatttggtgaaaaatataacaggtagttaaaaacatcagtgcagagtaaattgccggatgacatcagaatgatgccatccgaacggtggtttaaccctgacggttgaaacgttgcgttttaacgtccagcgttagcgtttcttctggttgtatcgcatacagtttctcaccctgctggcaaatccagccaattcccagttcacgggcgattagggcactgtgggatagcggacttccggcgctaaggcagataccttttacaaccgctggatccagttgcagtactgtggagggataaatgttctccgccagtagaatagttggcgagttaaactgcgggagttcttctttcgtttgggtcaggtggaccagggtgcgatgcagaagatcgtccacatcgatatagcgagcctgtagatattcatcatccagctgttggtattgctggctaagttctttaagaacttgctgccaggcatattccgccgtgcaatgttcatgctgaaggagttcgcttgccgccgcctgcagttccggatcatctaacagtgtatggtgaccagaaaagattgcggcaatatcgtcaagcccgcaggtttctgctttcgctgttaacgtcatcagatctaataacgtgaagtcaatggcctggcgtaatcgttcttgttcttcttccacggtcagggttgattttgcctgtaccgtacataaaacaggttgataataaaaggctttacccgaaacaggcggaacgggacgcagagtaggtggagcaacttcctccgtttcaccaaagttatcttcagccagctgacggaaagcgatcagtgcctcttcagcttctggtcctttcgcaatcaggcgcagcgtatcgttatagcgaacttgtagtaacgcaatctggttaatactatccggtgtaacgcatttgccgtttttctccagcaacatatcggcattaaatgtcgataaggtataaaccagccgggaggccggacgtacatgcaggccgttacggttttttatgaccaccgacagagaacgggcttcttcatcgtacggaggacatgtgtcagagatttcagtgtcggaggacggtaaacccagttgttcacgtttggcttccagcgcatgcatggcgtcaaagataactttgtcgatatccgcccccgaggccgcgctgaccgtagctgccagtgtaccttcgaccaacggcgcagcacacaaacgtacttttgcggcgatctcgggagccagcaattccagcgcagtttcagcactcaataatgcgctacccatatccatcatgaccagcacatggtcggcatcggcaacagattcgatggcctccatcactttgacggcatcggtaccaatgggattatgtggatcgtcaattcccgcggcaatggcgattttacaactatcactcattaacatctgacgggctaattcaccgacaccttctcccagtcggctgctatgtgaaactatgaccaggtttaccatcaccaattccttactcttttgcggctaacgccaacatttgcatcataaacatcaccgaggtcgcgccgggatcctggtgaccaatactgcgttcaccgagataactggcgcggcctttgcgggcttgcatcgtaatcgtactttgtgcagcggattcggcgatgctactggcagcgtcgagcgccgccggaacagggagattttgctcgcaggactgacgtaacgattccaccaccggcacccacacatcacacatggttttatcgccaggttcggctttcccgcgactgattacgccgtccgcgccatcgcggaacatctgataaagctcttccagcgtcaggctttgccgtgcctgggttgtctgtgcggcgcggataaagaaggtaccgaacagcggaccactggcacctccgacgctggaaagtagtgtcatgccggtattcttgagaatgaaaccgatatctttatctgcgatagcagggagtttttctaccactttgctaaagcctcgattcatatttagcccgtggtcagcgtcgccaatctcgcgatccagtccagtaagatacttgctctcggtgctgaaaatatcgccacaacgagtgagccagttaacaatttgagttctgctcagtgacattgctttctccttatttaccccagttaagggccggggtgtggacaggggcgtcccagaatgccagcgtttcgtcatcaactttcagtaaggtgattgagaaaccggtcatatccagtgaggtgcagtacgcgccaattaaattacgttcgatagtcaatcccgcttgctggcaacgtgtggtcaggcggttatagacgccgtacagctcagaaagcggagttgcgccaagattgttaaccagcgcaatcacccgatcgccagactggagcggttgtttggtttgtggttcttcctgccagctgccttgttgataatcccagaaacgcaaagtgcgatggtatgagccattttccagcagggtgtcgaacatttcatcgacggtttgatcaagggaagagaaggggcggcggtcaatacctggctcaccatgaatgccgacgccaaactccatctcattatccgccagggtaaaagaaggtttgcccgcggcaggaacggtacaggcaccgagagcgatacctattgaatggccttgattattcaacttacgccccagttccgcacaggcgtccagtgagtcgccacgctccgccgctgcacctacgagtttttcaattaatacggtgttggcaacgccgcgccgcccggcggtataaagactgtcttttactgcaacgtcgtcatcaatgaccacagtggtcacttttacgccgctatcgtgcagtaactcggttgctgtttcgaagttaagaatatcgccggtgtaatttttgataatcaacagtacaccttcgccgccatcaatttgcatggcgcattcaaagattttatcgggcgtcggtgaggtgaaaatttcgcccggacaggccccagaaagcatcccctgaccgatatagccacagtgcatcggctcgtgtccgctgccgccacccgacagcagggcgactttccctgcaacgggggcatcagctcgggtgacatacaccggatcctgatgcagtgtcagcgatggatgcgccttcgctagtcctgccagttgttcgtccagtacgtcttgcacatcattgatcaattttttcattattttgctccagcaattacggtagggcatggatgatgttcaacgacacggcgaccactgactgccgatgaatccattgtgcatcaggcaagggaaaagaaaattagcccaaattaggtttcatagtgaaacatattctttaatgaatgttccatattgaaacttttacgtgtattaatacttaaaattgcgagccggaacaccttttgtcataagggatgcgggatatgagtggcgcttttaacaacgatggtcggggcatatctcccttaattgcaacctcctgggagagatgcaataagctgatgaaacgggagacatggaacgtaccacaccaggcccagggcgtgacatttgcttctatttatcggcgtaagaaagcgatgctgacgctcgggcaggctgcgctggaagatgcctgggaatatatggcaccgcgagagtgtgcgttgcttatcctcgatgaaaccgcctgcattctcagccgtaatggcgatccgcaaaccttgcagcagctaagtgtactgggattcaatgacggcacgtattgcgccgagggaattattggtacttgtgcgctatcgttagcggctatctctggtcaggccgtgaaaacgatggccgatcaacatttcaaacaggcactctggaactgggccttttgcgcaacgccgttgtttgacagcaagggccgattgacgggaacaatagcgctggcgtgtccggttgagcaaactaccgcagctgatttgccgttgacgttggcaatcgcacgcgaggtcggaaatttactgctgacggacagtttgctcgctgaaactaaccgtcatttaaatcaacttaatgccctgttagaaagtatggatgatggcgtgattagctgggacgagcagggtaatttgcaatttatcaacgcccaggcggcgcgagtcttgcgccttgacgcgacggcaagtcagggaagggcaatcactgaactattaacgttacccgccgtattgcaacaagcaataaaacaggcacatccgctcaaacacgtagaagccacctttgaaagtcagcatcagtttattgatgcggtgataacccttaaaccgataatagaaacgcagggaaccagctttattttgttgctccatcctgtggaacagatgcggcagttaatgaccagtcaattaggaaaagtcagccataccttcgctcatatgccacaggacgatccgcaaacccgccgcttgattcattttggtcgccaggcggcgcgcagtagctttcctgtcctgctttgtggagaagagggcgtgggcaaggcactgctaagtcaggcaattcataatgaaagcgagcgtgcagcggggccttatatcgccgtcaattgtgaattatatggtgatgcggcgctggcggaagaatttattggtggcgatcgcacggataatgaaaatggccgtctgagtcggctggaactggcgcacggcggcacgctgtttcttgaaaagattgaatatctggcggtggagttacagtctgctttgcttcaggttatcaagcagggggttatcacgcgactggatgcgcggcgtttaatacccattgatgtcaaagtgattgccacaacgaccgcggacctcgcaatgctggtggaacaaaatcgttttagtcgccagctgtattacgcgctgcatgcatttgaaattaccatcccgccactgcgtatgcggcgtggcagcattccggcgctggtgaataacaaattacgcagccttgaaaaacgcttctctacgcggctgaaaattgatgacgatgccctcgctcgcctggtttcctgtgcatggcctggcaacgattttgaactttacagcgtcatcgagaatcttgctctgagtagtgataatgggcgcattcgcgtcagtgatttgccggaacatctgtttaccgagcaggcgacagatgatgtcagcgccacccgcctttccaccagtctgtcatttgcggaagttgaaaaagaggcaattattaacgcagcccaggtcacaggcggtcgcattcaggaaatgtcggctttacttggaatcggccgcactacgctgtggcggaaaatgaagcaacatggcattgatgcagggcagtttaagcgccgtggatagcgggagagtatgtactttcccgctatgaattactaattaatagcgaccatgactgccgtgatttggtccaccatttgaaggtggcattggcttaccggagggcgcaggaccacgagggccatcgctgtggcggtgatgatggtggggaacacaagcactcaacaggcttgcaaagacaattgctaacaggctgaaggtaaatatttttttcatgacaaactcttgaacggttaatgcactgtgattgttatcacataaaagctgcattgttaatattgtcaggagtctgattatgagttttggtaactcagaattgaaagaagacgcgtagcaggcgtaaaaaagccattacgtgcaactcacataatggctcgttattaaccgccagggtagtattagcggaattagacgttgaacaggaagttcatcacatcgccatctttaacgatgtaatctttgccttctgcacgcattttgcctgcttctttcgcgccttgttcacctttgtaagtgatgaaatcttcaaacgagatggtttgtgcacggataaagcctttttcaaaatcagtatggattttgcccgctgcctgcggcgcggttgcaccaaccggaatggtccatgcacgcacttctttcaccccagcggtgaagtaagtttgcaggttcagcagcttataaccggcacggatcacacggttcaggcccggctcttccagcccaagctcctgcataaactcgtcacgctcttcgtcgtccagttcggcaatgtctgcttcaacagcagcacaaaccggaactacaacagaaccttctttcgctgcgatttcacgcacctggtcaagatacgggttgttttcaaaaccgtcttcgttgacgttggcgatgtacattgttggttttagcgtcaggaagctcaggtaacgaacagccgctttctcttcagcgcttaaatccagcgcacgcagcatacctgcgttttccagctggggcaggcatttttccagtaccgccagctcggctttcgcgtctttatcgccacctttggctttcttctgtacgcgatgaatcgcacgttcacaggtgtcgagatccgccagcgccagttcggtgttgataacttcaatatcatccgccgggttaactttgccggaaacgtgaatgatgttgtcattttcaaagcagcgaacaacgtgaccgatcgcttcggtttcacggatgttggtcaggaactggttacccagaccttcgcctttcgatgcgccttttaccagaccggcgatatcgacaaattccatggtcgtgggaagtgtacgctgcggttttacgatttcagccagttgatccaggcgagggtcaggcattggtacgacgccagtgttcggctcgatggtgcagaatggaaagttggccgcttcaataccggctttggtcagcgcgttgaacagggtagatttcccgacgttgggcaaaccgacgataccgcatttgaatcccatgatttaaatcaccttaatatcttaataatcaacctgttattgctaacagattgcagaaatggaaataactttgcctattatacacggcactcggcaaaaatgccgcagacaacgacttattgcgctttaaaggcgtgcaatcggttcgtcgctttggtcaagccatctgtaaaccacatttcagtacaacgcgccgcttcgtcgatggcttcatcaattaacttctgttcactaacaggcggtttgcctaacacaaagccgacaactttatttttatcgcccggatgaccgattccgatgcgtaaacggtgaaagttagggttattacccaatttactgatgatgtctttcagtccattgtgaccaccatgaccgccacccaacttaaatttggcgacgccaggaggcagatccagttcgtcgtgggccaccagaatttcgtccggattaatgcggaaaaaactggccatcgccgcaacggctttgccgctgagattcataaatgtagtcgggactaacaggcggacatcttcgcctccaagggtgactcgcgaagtataaccaaagaatttagcctcttcgcgcagcggagcgcgcaatcgctctgccagtaagtcaacgaaccaggcaccagcattatgtcgcgttgcggcgtattcagcaccggggttcgccaggccgacaatcaatttaatcgtcacgtttttttgtcctgagtgtgtacataactggcgcgtagtttactggttgcggccctgcttgacaaaaaactgcgtatcaaatgcagataatgcaattattgcctgagtggactattagaaagtcaaggtgttcaggcgtttatttgtaaagttttgttgaaataagggttgtaattgtgatcacacccgcacataacctacagggtgttgtctatactttacacataaggaagaggggtattccctgttacaacccagaaagttccggaggtgacatatgaaacgcaaaaacgcttcgttactcggtaacgtgctcatggggttgggtctggtggtaatggtggtcggcgtggggtattcaatcctcaaccagttaccacagtttaatatgccccagtatttcgcacatggtgctgtgctaagtattttcgtcggtgcgattctctggctggcgggtgcccgtgttggcgggcatgaacaggtgtgcgaccgttactggtgggttcgccactatgacaaacgttgccgccgtagcgacaatcgccgtcatagctaacaaataatgcagtttgctgaccagtcagtttgcgctgactggtcaatctcgtacttataaatccgccatcgccgcgcgacgattcgggaagaatgcgaggcgtcccgggatcggttgaatgcctgcgcgagccatagtgcgcagtggctggaattccaggttgcacacgcgcagttcacatccttcgggcagacgcttcacaaaacgctggaacgcatcaagaccaccagcatcaagtaccggaacggcatcccacttcagaatcacaatccgtttgccttcaagacgtgactccaggtccgtgaataagccttctgcggcagcaaaaaacagcgggccaataacgcgcagaaccaggacatcgtctggaacgtctacgactaccggtgccaggcgagtcatacgtgcgatacgacgcataaacagcagcgatgccagcacgatccccacgctgatggcaataaccatatcgaacagcacggtcagcgacatgcacagcagcatgacgatgatgtcatctttcggtgcatgacgcagcaagtcgaccactttgtgcgcttcactcatgttccacgccaccatcaacagcagggctgccatggcggaaagcggcagccaggagagcagcggtgctagtaccagcagggcaagaataaccagaatagagtggatcaccgccgagataggggaagttgccccggcacggacgttagcggcagaacgcgcgatggcagctgtagcggtaataccaccaaagaacggagcgataatattccccaatccctgtccaaccagttcgctgttcgccttgtgttttgtcccggtcataccatccagcaccacggcgcagagcagagattcgattgcgccgagcattgccattgagaatgccgcaggcagcagtgtgcgaatagaatcccaggttagcgtgaattctgaattaggcagatcccacggcagcaccagttgcggcagcagttgcggaataccgttaccctgagaaccatcggccaggacgtagtggaattgcgaaccgatggtagcaacatgtccgccgagcaggttaacaatccccatcaccgcgcaaccagccagcaaggccggaaggtggccgggtaaacgtatgcccagacgcggccagaaaaccagaatgccaagcgtcacaatgccaatggctgcatcacccacattaatggtcggcagcgccataaataatgcgccgactttttgtagataatgttccgggacatgggccatttgcagaccgagaaaatctttaatctgcatggtaccgatggtgatcccgatacccgaggtgaaacctaaggtgacggaaaccggaatatactcaatcaggcgaccaaagcgtgccagccccatcagaatcaaaaagattcccgacagcaaggtcgcaaccagcagtcctgccagtccaaactgttgcgaaacgggatagagaattaccacaaatgccgcagtcggaccggaaacgctaaagcgtgacccccccgtcagagcaatgacaatccccgcaacagctgcggtatataaaccgtactggggggccacaccactaccaatagccaacgccatcgccagcgggatagcaataatcccgacggttatcccggcaatcaggtcacgggtaaaccgtgcggcagtatatttttctttccagcaagcgtcgatcagagcgcggaaaggcatcacatgtgaggaaaatattttgttcacaataatgtttcatccgtgagcgcatcatctgtcaactaaatggcaggtgaaggaggcataggtcatacaaatggatattacagacaaaaaaacccgccgcagcgggtctttgagccgggttcgattagtgttcgaacatggcagagatcgattcttcgttgctgatacgacgaatcgcttcggccagcatacctgacagggtcagagtacgcacgttcggcagtgatttgatttcatcgctcagcggaatggtatcgcagacaacgacttcatcaattacagagttacgcaggttgttcgccgcgttgccagagaagatcgggtgagtcgcgtacgcaaatacacgtttagcaccacgttctttcagagcttcagcagctttacacagcgtaccgccagtgtcgatcatatcatcgaccagtacgcagtcacgacctgcaacgtcaccgatgatatgcatcacctgggaaacgttcgcacgcggacgacgtttgtcgatgattgccatatcggtatcgttcagcagcttagcgatagcgcgggcacgcacaacgccgccgatgtccggagaaaccacaattgggttatccagattcagctgcagcatgtcttccagcaggatcgggctaccaaatacgttatcaaccggaacgtcgaagaaaccctgaatctgttcagcgtgcagatccactgtcagcacacggtcaacaccgacgctggagaggaagtctgcaaccactttcgcagtgattggtacacgagcggaacggacgcgacggtcctggcgcgcatagccaaagtaggggataacagcggtgatacgacctgcggaagcacgacgcagggcatcaaccataacgactaattccatcaggttgtcgttagtaggggcacaagtggactggatgatgaaaatatcaccaccgcgtacattttcattaatttgtacactgacttcgccgtcgctaaagcgacctacagcggcgtcgccgagtgaagtgtacaggcggttggcaatacgttgtgctagttccggggtggcgttaccagcaaaaagcttcatatcaggcacgagaagaacctcaggcatgcgtccattggtggaaagaatctgccgaaaactgtgcgggccaggcatgattctttccaggcggtgtattaaagagcgcgatgcaacgtctggaacaaggtgacgttgtcaccgaaactcagcttgcccggcttaaagcatggctctgtgcaatggggaaagattaacgcctttcgccacaaagccattgagccattccggggcttgctctagcacctggcgggcttcagactctgtatcaaattcagcaaagacacaggcccctgtcccagtcaggcgcgacggggcgtattctaacagccaggaaagcaccgcatcaacctcgcgaaaacgttttcttgcgataacctcgcaatcattgctgaattcacattttagcaacgtttctattgacctttttggcgtattgcgcgggagttcaggatctttaaaaatcaccggcgtcggaatactcacgccagggtgtgcgacgagataccatttctctggcgggtctaccggcgttaatatttcgccaacaccttcggcaaaggcggcatgaccacggacaaagacaggaacatctgcgcccagcgtcagccccatttccgccagctcatccatgcttagtccgcattgccagagatgatttaacgccaccagaaccgtcgcggcattggatgaaccaccgccgagaccgccgcccatcggcaaacgcttgtcaatgctgatattcgcaccgcttcccgtcgaaagacgcccgctgtctgccgcagttttcatcaacaacctcgctgcgcgaacgatcaggttatcttcatgttccacgccttcaacgggcgttaacagacgaatatccccatcgtcacgaagctcaatgctgatggtgtcgccgtaatcaagaaactgaaacagcgtttgcagcgtgtggtaaccatccgcacgctgaccggtaatgtataaaaacagattaagttttgccggagagggccactgtgtccgcattatttcactatccagttatccatttttaacttgatgcgttgaccaccgtcggtgagttccatattggctggcatcgcaggttgagtttttgtgtcataaccaccgtaaacaactttccagtttttgccattctggctgtaggtgatttcactcaggcggtactggtcgtcaagtttgtagtcagtcgcatcacccggtaaacctaaaatccactggcgcaagctgttgagcggaattggcattccggtcaatttgccaatcatctcttcggcgtcatcggaggtataacgctgacctttattgtcgactaactgcacgttacccggttgagcattcagctccagttccgtgctgcccaatgggttagtcagcagcagacggtagcgatcctggccagtttgttgccagaagaaacgggcgtacactttttgttggtcagaaatataagcgaacgcgccgcgagtttgatactgattaagattgcgcacgtcttgctgatgctgacgccattgtggcgaatccgggcttttgccaggacctttgggcgtggtaacggaacaggcagtgagcacaagagcagccagcggtagcaggcggataagacgaaaatcgggcaggggcataataatgacaagtccttgagatacgttgcagttataacccttaatatgctagcgttaccgttagccatcgtctatgttcacgttgtcttaattgccagaatctaacggctttcggcaattactccaaaagggggcgctctcttttattgatcttacgcatcctgtatgatgcaagcagactaaccctatcaacgttggtattatttcccgcagacatgacccttttagcactcggtatcaaccataaaacggcacctgtatcgctgcgagaacgtgtatcgttttcgccggataagctcgatcaggcgcttgacagcctgcttgcgcagccgatggtgcagggcggtgtggtgctgtcgacgtgtaaccgcacagaactttatctcagcgttgaagaacgggatgacctgcaagaggcgctcattcgctggttgtgtgattaccataatctcaacgaagacgatctgcgtaatagcctctactggcatcaggataacgatgcggtcagtcatttaatgcgcgttgccagtgggcttgattctctcgtccttggcgagccgcagatcctcggtcaggttaaaaaagcgtttgccgattcgcaaaaaggtcatatgaaggccagcgaactggaacgcatgtttcagaaatctttctctgtggcgaaacgcgttcgcactgaaacagatatcggtgccagtgctgtgtctgtcgcttttgcggcttgtacgctggcgcggcagatctttgaatcgctctctacggtgacggtactgctggttggcgcgggcgaaaccatcgagctggtggcacgtcatctgcgcgaacacaaagtacagaagatgattatcgccaatcgcactcgcgaacgtgcccaaattctggcagatgaggttggcgcggaagtgattgccctgagtgatatcgacgaacgtctgcgcgaagccgatatcatcatcagttccaccgccagcccgttgccgattatcggtaaaggcatggtggagcgcgcattaaaaagccgtcgcaatcaaccaatgctgctggtggatattgccgttccgcgcgatgttgagccggaagttggtaaactggcgaatgcttatctttatagcgttgacgatctgcaaagcattatttcgcacaacctggcgcaacggaaagctgctgctgtggaggcggaaactatcgtcgcccaggaggccagtgaatttatggcatggcttcgagcacaaagcgccagcgaaactattcgcgattatcgtagccaggcagagcaggttcgtgatgagttaactgctaaagcgttagcggcccttgaacagggcggcgatgcgcaaaccattatgcaggatctggcatggaaactgactaaccgcctgatccatgcaccaacaaaatcacttcaacaggccgcccgtgacggggataacgaacgcctgaatattctgcgcgacagcctcgggctggagtagcagtacatcattttctttttttacagggtgcatttacgcctatgaagccttctatcgttgccaaactggaagccctgcatgaacgccatgaagaagttcaggcgctgctgggtgatgcgcaaaccatcgctgaccaggaacgttttcgcgcattatctcgtgaatatgcgcagttaagtgatgtttcgcgctgttttaccgactggcaacaggttcaggaagatatcgaaaccgcacagatgatgctcgacgatcctgaaatgcgtgagatggcgcaggatgaactgcgcgaagctaaagaaaaaagcgagcaactggaacagcaattacaggttctgttactaccaaaagatcctgatgacgaacgtaacgccttcctcgaagtccgtgccggaaccggcggcgacgaagcggcgctgttcgctggcgatctgttccgtatgtacagccgttacgccgaagcccgccgctggcgtgtagaaatcatgagcgccagcgaaggtgaacatggtggttataaagagatcatcgccaaaattagcggtgatggtgtatatggtcgtttgaaattcgaatctggcggtcatcgcgtgcagcgtgttcctgctacggaatcgcagggtcgtattcatacttctgcttgtaccgttgcggtaatgccagaactgcctgatgcagaactgccggacatcaacccagcagatttacgcattgatactttccgctcgtcaggggcgggtggtcagcacgttaacaccaccgattcggcaattcgtattactcacttgccgaccggaattgttgttgaatgtcaggacgaacgttcacaacataaaaacaaagctaaagcactttctgtactcggtgctcgcatccacgctgctgaaatggcaaaacggcaacaggccgaagcgtctacccgtcgtaacctgctggggagtggcgatcgcagcgaccgtaaccgtacttacaacttcccgcaggggcgcgttaccgatcaccgcatcaacctgacgctctactgcctggatgaagtgatggaaggtaagctggatatgctgattgaaccgattatccaggaacatcaggccgaccaactggcggcgttgtccgagcaggaataatggaatatcaacactggttacgtgaagcaataagccaacttcaggcgagcgaaagcccgcggcgtgatgctgaaatcctgctggagcatgttaccggcagagggcgtacttttattctcgcctttggtgaaacgcagctgactgacgaacaatgtcagcaacttgatgcgctactgacgcgtcgtcgcgatggtgaacccattgctcatttaaccggggtgcgagaattctggtcgttgccgttatttgtttcgccagcgaccttaattccgcgcccggatacggagtgtctggtggagcaggcactggcgcggttgcctgaacaaccttgccgtattctcgatctcgggacgggtaccggggcgattgcgctggcgctggccagcgagcgtccggactgcgaaattaccgctgtagatcgtatgccagatgctgtctctctggcgcaacgtaatgcccagcatctggctatcaaaaatatccacattctgcaaagcgactggtttagcgcgctagccgggcagcagtttgcgatgattgtcagcaatccgccgtatattgacgagcaggacccacatcttcaacaaggcgatgtccgctttgagccgctcactgcgctggttgcggcagacagtggaatggcagacatcgtgcatatcatcgaacagtcgcgtaacgcgctggtatccggcggctttctgcttctggagcatggctggcagcagggtgaagcggtgcgacaggcatttatcttcgcggggtatcatgacgtcgaaacctgccgtgactatggggataacgagcgcgtaacgctcggccgctattatcaatgacaagtttttctacgttgcttagcgttcatctcattagtatcgcgctttctgttgggctattgaccttacgtttctggctacgttatcagaagcatccacaggcatttgctcgctggacgcgcattgtgccgccggttgtcgatacgctgttattgttaagcggcattgcgttgatggctaaagcgcacatccagccattttccgggcaggcacagtggctgactgaaaagctgtttggagttatcatttatattgttttgggttttattgcactcgattatcgtcgtatgcacagtcagcaggcgcgcattattgccttcccgctggcgttggtggtgctgtacatcatcattaaactcgccaccacaaaagtaccgttactggggtaagtcatgagatcgttagctgatttcgaatttaataaagcgccattgtgcgaaggcatgatcctggcttgcgaagcaatccgccgcgattttccctcgcaagatgtttacgacgaactggagcgtctcgttagtctggcgaaggaagaaattagccagcttctgccattagaagagcagctagaaaaattaatcgcgctgttttacggcgaatgggggtttaaagcctcacgcggcgtttatcgtctttccgatgcattatggctggaccaggtgttaaagaatcgacagggcagtgcggtatcattaggtgcggttttattatgggtcgcgaatcgtctcgatttgccgctgctgccggtgattttccctacgcagatgatattgcgcattgaatgtccggatggcgaaatttggctgattaatccttttaacggtgaatcgttaagcgaacatatgctggatgtgtggttaaagggaaatatcagcccgtcggcggaactgttttatgaagaccttgatgaagctgataacattgaggtaatccgcaaattgctggatacactcaaagcttcgttgatggaagaaaatcagatggagctggcgttacgcaccagcgaagctttattacaattcaacccggaagatccctatgaaattcgcgatcgcgggttgatttatgcgcaactggattgcgaacacgttgcgttgaacgatttaagttatttcgttgaacagtgtccggaagacccgatcagcgaaatgatccgtgcgcaaataaataacatcgcgcataaacatattgtgctgcattaattaatcgacattttactcaagattaaggcgatcctatgaaacaaaaagtggttagcattggcgacatcaacgtagcaaatgacctgccgttcgtactgtttggcggtatgaacgtgttggaatctcgcgatctggcgatgcgcatttgcgagcactacgtaaccgtgacccagaaactgggtatcccttacgtgttcaaagcctcttttgacaaagccaaccgctcctccatccactcttatcgtggaccgggcctggaagaagggatgaaaatcttccaggagttgaagcagacttttggcgtgaaaattatcaccgacgttcacgaaccaagccaggcacagcccgttgctgatgttgtagatgtgattcagttgccggcgtttcttgctcgccagactgacctggttgaagccatggcgaaaactggtgcggtaattaacgtcaagaaaccgcagtttgtcagcccgggacagatgggtaatatcgttgataaattcaaagaaggcggcaacgaaaaagtgattctttgcgatcgcggtgctaacttcggctatgacaacctggttgttgatatgctgggcttcagcatcatgaagaaagtgtctggtaattcgccggtgattttcgacgttacccacgcactgcaatgtcgcgatccatttggcgcagcttccggcggtcgccgtgctcaggtggctgagctggcaagagccggtatggcggtaggtctggcggggctgtttattgaagcgcatccggatccggaacatgcgaaatgtgatggtccatccgcgctgccgctggctaaactggaaccgttcctcaagcaaatgaaagcgattgatgatctggtgaaaggtttcgaagaactggataccagcaagtaatcttttttgcctgaaaaataaagtcttagcgttctgcgttaagacttttttcatgggtgccggatacaaaaaaggccgcaggctgttacccctgcggccggtttcgggcgcatattgccatcacggcagcctgacgcccgttttcaccttacttccggttacgccaccagccgacaatcgctgcggtaataattcccgcaaggatcggtgctgccaggtcgtgccagaaagtcatggcaaactgcgcgagcgtcatatagccgccttgttgtaatgacaacattttgcggctattcttgaattgttctggttcaagattagcccccgttctgttgtcaggttatacctctcaacgtgcggggggtttctctttccagcaaccaatgccaccagagataaagcccccgcaacattgcgcctcaccggataacgccggcttggtgtggatactacgtcgcaattcatcttcacttcatccctgaaatgtttgcaataaagagtacattccggtttttcaacagctgttgcagtcatttcgtgcaggttgtggtacaggcttgcaattctgattaacaacctgtccagctagtatgaagaaatataataagcaggaatttatattatctcccccgatttccgtcatcggaggagatataactgtcaggcaaatatcgtcatcaaataggcggcaaacagtgccagatgcgctgcgccattgagcacgttagttcgtccggtggagaaggagatatggcacagtactaaagaggccaccatcaccaccatttctggcgcaccaagtgcaaactgcaattcgttacccgtcataaaggcaattagcgtgacgacaggtacggtaagcgaaatggttgccaacactgaaccaaagaacagattcatcgcgcgctggacctggttattcaacactgcttttaacgcacctaaaccttccggcgacagaatcaacagagccaccaggaagccagtaaaggcgacaggcgcattcatgctgtcgagcaatgtctccagcgggctggcgttcattttggtgactgcaataacggcaatcagatggacaatcaaccagatggcatgccacaggctgctatgggcagacggtttaccgtggtgcgggtcgtcatcatcactgtcatcttcgtgctcgtagacaaacaaactttgatgcgttttggtctggatcagcaaaaatacgccatacattgccgcagaaattaatgctaccagtaacgcctgacctgttgaaaaattcgccgcaggcagcgccattggaaataccagtacgattatcgcaagggggaacagcgcaattaaatactgcttgataccaaacagattcatatattgggtggcaaacttacgtccgcccaacaataatgaaaagccaaccagcccacctgtaacaatcataatgattgaatagagcgtatcacgcattagcgttggcgcggcgtcgccggttgccattaaagctgaaatcaaactgacttcaagaataaccactgaaaggctaagaataagcgaaccgtaaggttctcccaggcgatgggctaatacgtccgcatgacggacaacactaaaggcgctacttaaaataccaataagcgcaagaagattgatggcaatgaccactggtagtgtctggctgcttccccacaggaacagcactaccagcgccagaaccgggaaaataagcgaagtctccttgtggcgggtttttaccgcctcttgagcatttgacattatggttatccctttgcagatgaatttatcgaaaatgtaaaaaataggtaggaaaaataacagaaagtgtctggatatcggtaacattttacgaatttttaccccgctgtcgattttttactcatttgggcataaaaataagtaatacgtttagacaatgtttgttttagcacttcttaagaagagtctgacatgaaaattcttatgttttggcaagagtagatattgttgaccacacttaatgttcaactttgtaaaaggagtcaacgatgccgtataaaacgaaaagcgatctgccggaaagcgtaaagcacgtgcttccgtctcatgtccaggatatctataaagaagcgttcaacagcgcatgggatcaatataaagataaagaagatcggcgtgatgacgccagtcgcgaagaaacagcgcataaagtggcctgggctgctgtgaagcatgaatatgccaaaggggatgatgataaatggcataaaaaatcgtaaaaccggtagcttagttaaagctattcgtgcggtgttgccttgcaagtggtccgtggattgcatattgtcccgttagtggtttcaaaatgagcagtaaaaatgtccggaagacaccaaaaagttgtcgcagggaagtatgcagtggcggaggtgtaaggtgataacgcgtgatttcttgatgaatgccgattgtaaaacggcatttggtgccattgaagaatcactcttatggtcagcagaacaacgggcggcttcgctggcggcgacgctggcttgtcgacctgatgagggaccggtgtggatcttcggttatggatcgttgatgtggaatccggcactggagtttaccgagtcgtgcaccggtacactggttggatggcatcgcgcgttttgcctgcgcctgaccgccgggcgcgggactgcgcaccagccgggacgaatgcttgcactgaaagagggcggacgcaccacaggcgtcgcctatcgactgccagaagagacgctggagcaggaactaaccctgctgtggaagcgcgagatgattaccggctgttatctgccaacctggtgtcagcttgatcttgatgatggacgcacagtaaacgccattgtgtttattatggacccgcgacatccagaatatgaatctgacactcgcgctcaggtcatagcgccgttgattgcggcggcgagcggtccgctgggaaccaatgcacaatacctgttttcactggaacaggagcttatcaaactgggaatgcaggacgatgggctgaatgatttgctggtatcggtaaaaaaactgctggcggagaattatccggatggtgtgttacggccgggattcgcctgagtaaacttccctcatagtggggcgtccgacgccccctcaaacattaaaatgtgagcactttatcggctgacagcgtccattgcgccagttcaacaagagtactgatttccaccccatcaatcagaggaagtgtactaatcccgcgcccgtcggtacaggttttgcacaatttcaccggtacattctgagcggtaaggatctccagcatttgctgaatgttgtagccttcccctggtttttgcccgcgcaacccggctgttaccgcatcagacatcaggaacagacgcagatccagattgttctcctgctctcgtaacgcaatggccagccgcaagctgttaaacaaggattcgctcccgtaaggtgcgccattggcaacgatcacgattttttgcattatttactcctgtattcagggaattagacactcatcttctatcttactgcttctgcagcgtctgaccaatcggtcacatttttaaggattttcctgaaagcgcgagaaaatacgacaaaaggtgccagtaatcgttattctttaaggctatggtttttcatttttaccggaagttaccgacgttttgagccgtttcgttcctcgcattattccgttttatttactcttgctggcggcaggcggtacagctaacgcacaatctaccttcgagcaaaaagcggcaaatccctttgataataacaatgatggtctgccggatttaggcatggcacctgaaaatcatgatggggaaaaacactttgctgaaattgtgaaagatttcggcgaaaccagtatgaatgataacgggcttgatactggcgagcaggcaaaagctttcgcattggaaaaggtccgcgacgcgcttagtcaacaggttaatcagcacgtagagtcctggctatcaccgtggggaaatgccagtgttgacgtcaaagtggataacgaaggacatttcaccggcagtcgtggaagctggtttgtgccgttacaagataatgatcgttatctcacctggagccagcttggtcttactcagcaggatgatgggctggtgagcaatgtgggcgttgggcaacgctgggcgcgcggcagctggctggtgggttataacactttttatgacaacttgctggacgaaaatcttcagcgagcgggctttggcgctgaagcgtggggcgaatatttgcgactatcggcaaacttttatcagccgtttgctgcatggcatgaacagacagccacgcaggaacaacggatggcgcgcgggtacgacctgacagcccggatgcgcatgccgttctatcaacacttcaataccagtgtcagcgtagaacagtattttggtgatcgtgtcgatttgtttaactctggtacgggttatcacaatcccgtcgcgttgagtctgggattaaattacacccctgtgcccttagtcactgtgacggcccagcataaacagggtgaaagtggcgagaatcaaaataacctcgggctgaatcttaactaccgctttggtgtaccgctcaaaaaacaactttctgcgggcgaggttgtcgaaagtcagtcgttacgtggtagtcgctatgacaatccgcagcgaaataatcttccgactcttgagtaccgacagcgaaaaacgttgacggtgtttctggcgacaccgccgtgggatctaaaacctggcgaaacagtgccgctgaaattacaaatccgcagtcgttacggtattcggcaactgatttggcagggcgatacgcagatattaagtttgacgccgggcgcacaagccaacagtgaggagggctggacgctgatcatgcctgactggcaaaacggggaaggcgcaagcaatcactggcgattgtcagtggtggtggaagataaccaggggcagcgtgtctcctccaatgagatcacgctaacgcttgtcgaaccgttcgacgcattgtcaaacgacgaactgcgctgggaaccgtaatcagaaaatgcgctcctgatgcacccataccgcagcttccacgcgagactttagcttcattttcttcagcatgtgcttgacgtgaacttttactgtgctttcggtgatgtccaggcggcgggcaatcatcttgttcggcaaaccctgggcaattagcttgagaatatcgcgctcgcgtggggttaactggttaacatcgcgctcagtagtggcacggttagcgcgcaagctggcggccagaacaggcgttaatgcttcgcttaataccatttcgccagcagctgcctgatgtaacgctttcagcagatcttccggttccatatcttttaacagatagccatccgcgccgcgtttcagtgcggtgaccacatcttcttcatggttagagacgctgaataccacaatgcgcccggagagggacttttcgcgcagtttatccagcgtttccagaccgttcatgccgggcatattgagatctaacaggatcagatcgggatcaagagactccgccagttcaataccctgttcgccattactcgcttcgccaaccacggtgatatctggtgccatactgataagctgttttacgccagttcgcaacatcgggtgatcgtcgatcagcaggatagtagccggttcctgattactcatgggtatctccttggacgtctgtgaaagttttttcgggaataaaggtgaccaccacttcggtgccacctgattcacgacggcggacgcggcaatcgcctcgtaaactttgcgcacggtcgcgcattattatcatgccgtagtgattgctgcggatggcattttcaggcacgccgcagccgttatcctggacggtcagtttgacctgattatcgttttgcgccaccgtcaccacgacctcactcgcttgcgaatgtttgagggcgttacttaatgcctcacgggcaatttgcaacaagtggattgcctgatgcgaaggcaccagacgaggcggcaattgataatccagcttcaccgggaagccaaatttggcgctgtactcttcgcaactcgcctccagcgccggacgtaatccaggctcggtgagctgcaaacggaatgtggtgagcaattcacgcaactgcacccaggatgcattcagttcgttacggatctgacttaacagttcgcggctgctttctggcagcgcatcgccctgcatctgtaagcaactcacctgcatcttcatgcaagagagagattgggcaatagaatcatgcagttcgcgcgcaatggtggcacgctcttccatcacgatcaactgttgctgacgttcctgatggcgatccagcgccagcgtggcggtgagttgttcaaccagggtatccaccagttgttgttgatcatggctaagatgacgcccctgcggcagggtcgccagcaaaataccgtactgcgtatgagtgtcagccagccgccacttcagggttgtgccgcgatcgccaacgggtaatacgccgcgcgggcagagctggcagcctttatcatcacaagtcatatctgactggcaggtaaactcctgatgattctcttcatcatcagtgtcatacacccgcagttcgatatcacgtagcagggttaaattctgtaagtcgttgagtacaggtgacaggcgttcacacagcggggcgcgggaatgcaaacggcggttagcctgccataaaaaagagaggatctgatttttatgctccagcccggcggttttctcctgaacccgctgctcaagtacggcataactttccgccagttctgcagacatattgttcaacgcagttccaagcatcgccatttcgttgcgcccgctgatgtttgcgcgttgggtaaaatcgcgatggctgacggcactcgccattgccagcagttgccgccacggttgtagcaatctcgcccgcaaccagataatagtgaataccagtaaaagtgccataaataccgccattacccgatggaccagcaccactgtctcaatgcgcatttccgtggtgcgatcaaaaccagataccagctgatcaagcccggcaacaaactggctgacatccgctgacaccgtttcgcggttttgtgcacgtatcagtgcagggatcagttcattacgccagtaatcttgtaaaccctgtaattgcgccagttgcccgtctcgttctgctgctcgagtcaactcggcgctaaatgctgtttgttccatctctttaattaagggcttgtctttctcgcttaatggcactgctgccaacagacggtaactttgcatgcgcagcgatcccgctttgttgatcgcatgggcgctgccctgaacgccttgcaccagccagccagaaaccgccatccctgccagtccaatagcagtagaaagcaacacaataagcgcaacctgattaaccagggtgagcggagagagacaacgtttaagcatgtaaacctcttccttcaggctttaaatgagcaataaccttaatgaatgtgacgatacattctggaatggcagtattctcggctattggctggagtatacccatacccggaaagagttactccttatttgccgtgtggttagtcgctttacatcggtaagggtagggattttacagtaccgtgaaaaatctcataatttttatgaaatcactgtactcactatggataatgataaatatcaatgatagataaagttatcttatcgtttgatttacatcaaattgcctttagctacagacactaaggtggcagacatcgaaacgagtatcagaggtgtctatgagtcactcatccgcccccgaaagggctactggagctgtcattacagattggcgaccggaagatcctgcgttctggcaacaacgcggtcaacgtattgccagccgcaacctgtggatttccgttccctgtctgctgctggcgttttgcgtatggatgttgttcagcgctgttgcggtgaacttaccgaaagtcggttttaattttacgaccgatcagctatttatgttgactgcgctgccttcggtttctggcgcgttattacgtgttccatactcctttatggttcctatcttcggtggtcgtcgctggacggcgttcagcaccggtattctgattattccttgcgtctggctgggttttgccgtgcaggatacctccacgccttatagcgtcttcatcatcatttctctgctgtgcggctttgctggcgcgaacttcgcatccagtatggcaaacatcagcttcttctttccgaaacagaagcagggtggcgcgctgggtctgaatgggggtctgggcaacatgggcgtcagcgtcatgcagttggttgctccgctggtggtatcactgtcgattttcgcagtatttggtagccagggcgtcaaacagccggatgggactgagctgtatctggcgaatgcgtcctggatatgggtgccgttacttgccatcttcaccattgcggcgtggtttggcatgaacgatcttgccacctcgaaagcctccatcaaggagcagttgccggtactcaaacggggtcatctgtggattatgagcctgctgtatctggcaaccttcggctccttcatcggcttctccgcgggctttgcgatgctgtcaaaaacgcagttcccggatgttcagattctgcaatacgctttcttcgggccgtttattggtgcgctggcgcgttctgcaggtggtgcattatctgaccgtctgggcggaactcgtgtcacgctggtgaactttatcctgatggcgattttcagcggcctgctgttcctgaccttaccgactgacggacagggcggaagcttcatggcgttcttcgcagtcttcctggcgctgttcctgaccgctgggctgggtagtggttccactttccagatgatttccgtgatcttccgtaaactgacaatggatcgcgtgaaagcagaagggggttctggcgaacgtgcgatgcgtgaagcggcaaccgacacggcagcggcgctgggtttcatctctgcgattggcgcgattggtggcttctttatcccgaaagcgtttggtagctcgctggcattaacgggttcgccagtcggcgcaatgaaagtatttttgattttctatatcgcctgcgtggtgattacctgggcggtatatggtcggcattctaaaaaataaatcgtaatatttgattatcctttgcgcggcatgatgtcgcgctttttttatacgtcatttagttacaacatactaatgttgtatggcttatttcgctggatttcattaagagtcattaatatgttatccatggggaatactccttaatacccatctgcataaaaatcttaatggtttaaataactacaggtgtaaaacgtcttaatttacagtctgttatgctataaatgttaattatcctaaaggggtattccaggaatttactttatttttcatccccatcactcttgatcgttatcaattcccacgctgtttcagagcgttaccttgcccttaaacattagcaatgtcgatttatcagagggccgacaggctcccacaggagaaaaccgatgagtaaattcctggaccggtttcgctacttcaaacagaagggtgaaacctttgccgatgggcatggccagcttctcaataccaaccgtgactgggaggatggatatcgccagcgttggcagcatgacaaaatcgtccgctctacccacggggtaaactgcaccggctcctgcagctggaaaatctacgtcaaaaacggtctggtcacctgggaaacccagcagactgactatccgcgtactcgcccggacctgccaaaccatgaacctcgcggctgcccgcgcggtgccagctactcctggtatctttacagcgctaaccgcctgaaatacccgatgatgcgcaaacgcctgatgaaaatgtggcgtgaagcgaaggcgctgcatagcgatccggttgaggcatgggcttctatcattgaagacgccgataaagcgaaaagctttaagcaggcgcgtggacgcggtggttttgttcgttcttcctggcaggaagtgaacgaactgatcgccgcatctaacgtttacaccatcaaaaattacggcccggaccgtgtcgctggcttctcgccaattccggcaatgtcgatggtttcttacgcatcgggtgcgcgctatctctcgctgattggcggtacttgcttaagcttctacgactggtactgcgacctgcctcctgcgtctccgcaaacctggggtgagcaaactgacgtaccggaatctgctgactggtacaactccagctacatcatcgcctggggttcaaacgtgccgcagacgcgtaccccggatgctcacttctttactgaagtgcgttacaaaggaaccaaaactgttgccgtcacaccagactacgctgaaatcgccaaactgtgcgatctgtggctggcaccgaaacagggcaccgatgcggcaatggcgctggcaatgggtcacgtaatgctgcgtgaattccacctcgacaacccaagccagtatttcaccgactatgtgcgccgctacaccgacatgccgatgctggtgatgctggaagagcgcgacggttactacgctgcgggtcgtatgctgcgcgctgctgatctggtggatgcactgggccaggaaaacaatccggaatggaaaactgtcgcctttaataccaatggtgaaatggttgcgccgaacggttctattggcttccgctggggcgagaagggcaaatggaatcttgagcagcgcgacggcaaaactggcgaagaaaccgagctgcaactgagcctgctgggtagccaggatgagatcgctgaggtgggcttcccgtactttggtggcgatggcacggaacacttcaacaaagtggaactggaaaacgtgctgctgcataagctgccggtgaaacgcctgcaactggctgatggcagcaccgccctggtgaccaccgtttatgatctgacgctggcaaactacggtctggaacgtggcctgaacgacgttaactgtgcaaccagctatgacgatgtgaaagcttacacccctgcctgggcagagcagattaccggcgtttctcgcagccagattattcgcatcgcccgtgaatttgccgataacgctgataaaacgcacggtcgttcgatgattatcgtcggcgctgggctgaaccactggtatcacctggacatgaactatcgtggtctgatcaacatgctgattttctgcggctgtgtcggtcagagcggcggtggctgggcgcactatgtaggtcaggaaaaactgcgtccgcaaaccggctggcagccgctggcgtttgccctcgactggcagcgtccggcgcgtcacatgaacagtacctcttatttctataaccactccagccagtggcgttatgaaaccgtgactgcggaagaactgctgtcgccgatggcggataaatctcgctataccggacacttgatcgactttaacgtccgtgcagaacgcatgggctggctgccgtctgcgccgcagttaggcactaacccgctgactatcgctcgcgaagcagaaaaagccgggatgaatccggtggactatacggtgaaatccctgaaagagggttctatccgtttcgctgcggaacagccggaaaacggtaaaaaccacccgcgtaacctgttcatctggcgttctaacctgctcggttcttccggtaaaggtcatgagtttatgctcaagtacctgctggggacggagcacggtatccagggcaaagacctggggcagcagggcggcgtgaagccggaagaagtggactggcaggacaacggtctggaaggcaagctggatctggtggtgacgctggacttccgtctgtcgagcacctgtctctattccgacatcattttgccgacggcgacctggtacgaaaaagacgacatgaatacttcggatatgcatccgtttattcacccgctgtctgcggcggtcgatccggcctgggaagcgaaaagcgactgggaaatctacaaagccatcgcgaagaaattctccgaagtgtgcgttggtcatctgggtaaagaaactgacatcgtcacgctgcctatccagcacgactctgccgctgaactggcgcaaccgctggatgtgaaagactggaaaaaaggcgaatgcgacctgatcccaggtaaaaccgcaccgcacattatggtcgtagagcgcgattatccggcaacttacgaacgctttacctctatcggcccgctgatggagaaaatcggtaacggcggtaaagggattgcctggaacacccagagcgagatggatctgctgcgtaagctcaactacaccaaagcggaaggtccggcaaaaggccagccgatgctcaataccgcaattgatgcggcagagatgatcctgacgctggcaccggaaaccaacggtcaggtagctgtaaaagcctgggctgccctgagcgagtttaccggccgtgaccatacgcatctggcgctgaataaagaagacgagaagattcgcttccgcgatattcaggcacagccgcgcaaaatcatctccagcccgacgtggtctggccttgaagatgaacacgtttcttacaacgccggttacaccaacgttcacgagctgatcccgtggcgtacgctctctggccgtcagcagctgtatcaggatcaccaatggatgcgtgatttcggtgaaagcctgctggtttatcgtccgccgatcgacacccgttcggtgaaagaagtgatgggccagaaatccaatggcaacccggaaaaagcgctcaacttcctgacgccacaccagaagtggggtatccactccacctacagcgacaacctgctgatgctgactttaggtcgcggtggtccggtggtctggctgagtgaagccgatgccaaagagctgggtatcgccgataacgactggattgaagtcttcaacagcaacggtgcactgactgcccgtgcggttgtcagccagcgtgttccggcagggatgaccatgatgtaccacgcgcaggaacgtatcgttaacctgcctggttcggaaattacccaacagcgtggtggtatccataactcggtcacccgtatcacgccgaaaccgacgcatatgatcggcggctatgcccatctggcatatggctttaactactacggcaccgtaggttctaaccgcgatgagtttgttgtagtgcgtaagatgaagaacattgactggttagatggcgaaggcaatgaccaggtacaggagagcgtaaaatgaaaattcgttcacaagtcggcatggtgctgaatctcgataagtgcatcggctgccacacctgttcagtgacctgtaaaaacgtctggaccagccgtgaaggcgtggaatacgcgtggttcaacaacgtggaaaccaagccgggccagggcttcccgactgactgggaaaaccaggaaaaatacaaaggcggctggatccgtaaaatcaacggcaaactgcagccgcgcatgggtaaccgtgccatgctgctgggtaaaatcttcgctaacccgcatctgccggggatcgacgattattacgagccgttcgattttgattatcagaacctgcataccgcgccggaaggcagcaaatcacagccgattgcccgtccgcgttcactgattaccggcgaacggatggcgaaaatcgaaaaagggccgaactgggaagatgacctgggcggtgagtttgacaagctggcgaaagacaagaacttcgacaacatccagaaggcgatgtatagccagttcgaaaacaccttcatgatgtatttgccgcgcctgtgcgaacactgtctgaacccggcatgtgtggcgacctgcccgagcggtgcgatttacaagcgtgaagaagatggcatcgtcctgatcgaccaggataaatgccgtggctggcgtatgtgcatcaccggatgcccgtacaaaaaaatctacttcaactggaagagcggtaagtctgagaagtgcatcttctgctatccgcgtattgaagccggccagccgacaatatgttcagaaacctgtgtcggtcgtatccgttatcttggcgtgctgctgtacgatgccgacgcgattgaacgtgcggcaagtaccgagaacgagaaagatctctaccagcgtcagctggatgtgttcctcgatccgaacgatccgaaagtcatcgagcaggcgattaaagacggtattccgctgagcgttattgaggctgcgcagcagtcgccagtttataaaatggcgatggaatggaaactggcgctgccgctgcatccggaatatcgcacactgccgatggtctggtacgtgccgcctctgtcgccgattcagtctgcggcagacgcgggtgaactgggcagcaacggcattctgccagacgtcgaaagcctgcgtattccggtacagtatctggcgaatctgctgaccgccggtgataccaaaccggtactgcgcgcgctgaaacgtatgctggcgatgcgtcattacaaacgtgctgaaaccgttgacggtaaagtcgatacccgtgcgctggaagaggtcggtctgaccgaagcccaggcacaggagatgtatcgttatctggctattgccaactacgaagatcgctttgtggtgccgagcagtcatcgtgaactggcgcgggaagccttcccggagaaaaatggctgcggctttacctttggtgatggctgccacggttcagataccaaattcaatctgttcaacagccgccgtatcgatgccatcgatgtaaccagcaaaacggagccgcacccatgatcgaactcgtgattgtatcgcgtctccttgaatatccggatgctgccttatggcagcatcaacaagagatgtttgaggcgattgccgcgtcgaaaaatctgccaaaagaggatgcccatgcgctgggcattttcctgcgcgatttaacgacgatggatccgctcgatgcccaggcgcagtacagcgaactgttcgaccgtggccgcgccacgtcactgttgctatttgaacatgtgcacggtgaatcccgtgaccgcggccaggcgatggtggatctgctggcgcagtacgagcagcacggcttgcagttaaacagccgcgaattgcccgaccatctgccgctgtatctggagtacctggcgcagctgccgcaaagcgaagccgtggagggtttgaaagatattgcgccgattctggcattgctgagcgcgcgtctgcaacagcgtgaaagccgttatgccgtgctgtttgatctgctgctgaaactggcgaataccgcaatcgacagcgacaaagtggcggaaaaaattgccgacgaagcgcgcgacgatacgccgcaggcgctggatgcagtctgggaagaagagcaggttaaattctttgctgacaaaggctgcggtgattcagcaatcactgctcatcagcgtcgctttgccggtgccgtcgcgccgcaatatctgaatatcaccaccggaggacagcactaatgcaattcctgaatatgttcttctttgatatctacccgtacatagccggggcggtcttcctgattggtagctggctgcgttatgactacgggcagtacacatggcgtgcggcgtccagccagatgctggatcgcaaagggatgaatctagcgtcgaacctgttccatatcggtattctggggatttttgtcggtcacttcttcggtatgctgacgccgcactggatgtatgaagcctggctgccgattgaagtgaaacagaaaatggcgatgtttgctggtggtgccagcggcgtactgtgtctgattggcggcgtgctgttgttgaaacgtcgtctgttcagcccacgcgtgcgtgcaacgactaccggagcggatatcctgatcctgtcgctgctcgttatccagtgcgcgctgggcctgctgaccattccgttctccgcccagcatatggacggtagcgagatgatgaaactggttggctgggcgcagtcggtagtgaccttccacggtggcgcttctcaacatcttgatggcgtggcgtttatcttccgtctgcacctggtgttggggatgacgttattcctgctgttcccgttctcgcgtctggtacacatctggagcgtcccggtggagtatctgacgcgtaagtatcagctggtgcgcgctcgtcactaagcgaattttagttcacatagaccctgcttcggcgctgagggatccccataaatcagcgataataaaccaacaccatattctggtaggttctggtgaggtgattaagaatggtgcttagcaccgttcgttttaaaattagcggggagtgtcgtaagacattctccgctaacgtcagatacgagattacccgccgcgttttaatgctgttggcctgatatataagatgtaacccttgattttcagcgtgatagccaataagccacagcactattgtgctcagtgttgccagcaggctcagtaccagcattcttcctgccgaacagctgtaactggctcgcagaccgaacccaaaacgctcacttttttcatccctggagttttgctcaatctgcattcggcgactgtataacttcatgatttctcgcggtttaaagtcatctgtgctgctgaatattaaccatggttcttttgccgccgacctggcatcttttatctgtgatggtctggctataccacaacgcgaacgtttatttctccggcctttcggctcttttttgtgcaaataaaaatgaccatcgcaacgggcgtattccgcccgggaaagcgtccacggccccagatattcaggtttgttactggcctgtaattcctgacgcccgaaccagcattccccttttctcgccagatgcagttgtttattgcctcgtatccggccaataaaatcccagccgagtgattttatgtgccgaaaccaggcattctggaaccctgcatccgtgacgatgattacccttgcttttgggtttaccgcttcggaaagagtattaagaaaggcttgctatatctttgcattttgctgtttttccgaaggaactatccaactcagcaatggaatcgaatgtccatcgcaaatcaggctggcgcggagtacgtgatactcctgagaggggtatccactccagtcaacggcgatgacacacagtgacagcttgctcgtcagcatggaaataatgtttctgaaaatcagggggatgtcgtgatgaagagactcattaccgagcagacgatcaacacgttttattttatttttgacctgagcattaccgggtaaataacgtccgatgctggtcagcgtcagagatgcgccattgataagtgcgatagtggcatccaacaaagcattttgtcggtatttgtgaaatggtgctaaagcaccgcggaaaaaattctgacatacttggcgagcaggcatagaggagatctcattgaattggttgcacaagtcagtagatcacaaaactctatgcctgtctttttttacccgcccattactggggattcctcagcgctccggcgggtttttttatgggcacggtgcggggggagttgtcggatgcgcttcgcttatccgacctacaggggaggatattttaggtccggtaaacgcggtgccatcgggcagaattagctcggagtaacaggttttgagtatttacaggaagtgatggtggtgggggaaggattactcagcgctgcgcgcttcgcccttcgggtcgttgcctgcggcaacgctctctcgctggcactcgagtcgaaccttggtcgaagcttctcatccttccccgcatgggcagaatatttaattgcggattcgtttgagaattcaggggcttttgaaagcgatggtggtgggggaaggattcgaaccttcgaagtcgatgacggcagatttacagtctgctccctttggccgctcgggaaccccaccaggggtaattcatattgtaggtaatgcttgagatggtggtgggggaaggattcgaaccttcgaagtcgatgacggcagatttacagtctgctccctttggccgctcgggaaccccaccacggggtaatgctttttactggcctgctcccttatcgggaagcggggcgcatcatatcaaatgacgcgccgctgtaaagtgttacgttgagaaaaatgaactggttgcgtgattttcatccgtaacggattaaagctaaccagttattttggctgacgattaaagaataatcgtccgattaccgtaaacaaagacgcgctgcgccagtactttgtatagcgcacgacttaagacgtttttctcgacgtcacgacctgcgcgcatcatatcttcagctgtgtaggtatgatcgacatgaataacgtcctgcatgatgattgggccttcgtccagattgtcattcacatagtgagcggttgcgccaataatcttcacgccacgctcataggcctggtgataaggacgtgcgccgataaacgctggcaggaatgaatggtgaatattgatgatcttattcgggaagcgtgccacaaattccggcgttaatacccgcatatacttcgccagcaccacatagtcaggttgataagcatcaatggcatccgccatcttttgatcgtgctcgttgcggcttaacccttcatggcttaccagctcaaacggaatatcaaaccgctcaaccagagaacgtaaagtatcgtggttaccaataactgccgcgatttcgacatccaggccaccgtaattggctttcatcaataaatcgccaaggcaatgcgcttctttagtgaccagaattactatccggcgacgaccggcaggattcagctcacgcacggagccttctggcaatgcgctatcgagatccgccagcagggtggaatcattaaaaatcccttccagttccgtgcgcataaaaaagcgcccggtacgatgatctacaaattcattgttctgcacgatatttaactcgtgcttgtagcaaatattggtaatacgtgcgatcagacctttttggtccggacaaatagtacgcagaactttacgttggagtgaatgcattgctggaaaaaccttgttgagagtgtttgctaaaccgtaccgtcaaccattattggccgcagcactttttaaattttttacctgaaccacaagggcagggatcgttgcggccaaactgcggacgtgtaccgtcaatatagtaccattgaccgttttctttcaaaaatcgcgaacgttcaattattgcacctgttttgccaccctcggtaaatcgagcaacaaaactgacaaatccgatattgccgccgtcctgccagcaatgttcaaatacggtcaatcccaaccattcagtatgcgcaaatccggcaatcaattcggcacgtaacgccgctgctccacaagatggatgccaggtctttattaaataatctgcgtcttgcatcacaaaagcgcagtaacgcgaacgcatgagatgttctggatcaggtgcaaccttttcaccaaacacataagggtggcaacataggctatactcgacagcactaccacagggacaaagctgagacacaaataatctccctggaaacaataacggcgtattaaccgcctgagtagcactatgttaaccgagcagtagcgatgtggctacgattgcattccaggggaatcttgcgggaataatgagaaagataaaaatagggctggcgctgggatctggcgcggcaagaggttggtcgcatattggcgtaattaatgcgctaaaaaaagtgggtattgaaattgatatcgttgcaggatgttcaattggttcgctggtgggcgctgcctatgcatgcgatcgattatctgcgctggaagattgggtgacctctttcagttattgggatgttttacgcctgatggatctctcctggcagcgcggtgggttactgcgcggcgagcgtgtcttcaatcaatatcgcgaaataatgccggaaacagagatcgaaaattgttcccgtcgcttcgcggctgttgccaccaatttaagtactgggcgtgaattatggtttactgaaggcgatctccatcttgctattcgtgcatcatgcagtattccaggactaatggcacccgttgcgcataacggctactggctggttgatggcgctgtagttaacccaattcctatttccctcacgcgtgcattgggggctgatattgtgatagcggtcgacctgcagcacgatgctcatttgatgcaacaagatttgctctcctttaatgtcagtgaagaaaatagcgagaatggtgattctctgccgtggcatgcgcgtctgaaagaaaggttaggcagcataacgacacgtcgggcggtgacagcgccaacggcaacagagattatgaccacttctatccaggtgctggagaaccgacttaaaaggaaccgcatggcaggtgatccgcccgatattctgattcaacctgtttgcccgcaaatatctacgcttgatttccatcgcgcgcacgctgccattgcggccggacagctggcagtggaaaagaaaatggacgagcttttgccgttggtacgcaccaacatttgaccagaatttttatctacacttaagttaattctgacaggcgtaggtggcaatagcgtgccactattgagtaaagccagtcaggggagagaacatgacgcagccattggtcggaaaacagattctcattgttgaagatgagcaggtatttcgctcgcttctggattcgtggttttcctcattgggagcgacaacggtactggcggctgatggggtggatgcccttgagttgctgggaggtttcactccagacctgatgatatgtgatatcgcgatgccacgaatgaacgggcttaaactgctggaacatatacgcaacagaggtgaccagacaccagttctggtgatatctgccactgaaaatatggcagatattgccaaagcgttacgtctgggcgttgaagatgttttgctgaaaccggttaaagatctgaatcgcttgcgcgagatggtttttgcctgtctctatcccagcatgtttaattcccgcgttgaggaagaggaaaggctttttcgcgactgggatgcaatggttgataaccctgctgcagcggcgaaattattacaggaactacaaccgccagttcagcaggtgatttcccaatgccgggttaattatcgtcaattagttgccgcggacaaacccggcctggtgcttgatattgccgcactttcggaaaacgatctggcattttattgccttgatgtcacccgagctggacataatggcgtacttgctgccttgttattacgcgcattgtttaacggattattacaggaacagcttgcacaccaaaatcaacggttgccagagttgggcgcgttattgaagcaggtaaaccatttactccgtcaggccaatctgccggggcagtttccgctattagttggctattatcatcgcgaactgaaaaatctcattctggtttctgcgggtctgaatgcgacgttaaataccggcgaacatcaggtgcaaatcagtaatggtgttccgttaggcactttaggtaacgcttatttgaatcaattgagccagcgatgcgatgcctggcaatgccaaatatggggaaccggtggtcggctgcgcttgatgttgtctgcagaatgagcaaacgataacacgggctaaatttgcattacctgctaatgtcggctggtggtactatcgtcgctattcgtataagtaattgtcttaattatgctaactcgcctccttttcagaacttagccccttcggggtgctgatatactgggatgcgatacagaaatatgaacacgttcaaaacacgaacagtccaggagaatttaaatggctgccattaatacgaaagtcaaaaaagccgttatccccgtagcgggattaggaaccaggatgttgccggcgacgaaagccatcccgaaagagatgctgccacttgtcgataagccattaattcaatacgtcgtgaatgaatgtattgcggctggcattactgaaattgtgctggttactcactcatctaaaaactctattgaaaaccactttgataccagttttgaactggaagcaatgctggaaaaacgtgtaaaacgtcaactgcttgatgaagtgcagtctatttgtccaccgcacgtgactattatgcaagttcgtcaggggctggcgaaaggcctgggacacgcggtattgtgtgctcacccggtagtgggtgatgaacctgtggctgttattttgcctgacgttattctggatgaatatgaatccgatttatcacaggataacctggcagagatgatccgccgctttgatgaaacgggtcatagccagatcatggttgaaccggttgctgatgtgaccgcatatggcgttgtggattgcaaaggcgttgaattagcgccgggtgaaagcgtaccgatggttggcgtggttgaaaaaccaaaagcggatgttgcgccgtctaatctcgctattgtgggtcgttacgtacttagcgcggatatttggccgttgctggcaaaaacccctcctggagctggtgatgaaattcagctcaccgacgcaattgatatgctgatcgaaaaagaaacggttgaagcctatcatatgaaagggaagagccatgactgcggtaataaattaggttacatgcaggccttcgttgaatacggtattcgtcataacacccttggcacggaatttaaagcctggcttgaagacgagatgggcattaagaagtaacatccgtatcggtgttttccacgaaacggcgttgagcaatcgacgccgtttttttatagcttattcttattaaattgtcttaaaccggacaataaaaaatcccgccgatggcgggatttttagcatgtgcaatctacaaaagattattgcttgatcaggaaatcgtcgagggatttaccttgctcatccattgcttttttgattacagctggagtacggccctggccagtccaggttttagtttcgccgttttcgtcaacgtagctatattttgccggacgctgagcacgcttagctttggtgccagatttaacggcagcaaggctattcagcagttcgttcgggtcaataccgtcagcgatcagcatttcgcgatattgctgcagtttccgagtgcgctcttcaacttcagcagcagccgcgctttcttcttcgcgacgttcgttaacaacaacctctaatttttccagcatttcttccagcgtttcaagtgtacattctcttgcctgcgcacgaagagtacggatgttgttcagaattttaagtgcttcgctcattgtagtaatctcaaacttatattggggtggtttgttgaggtaataatagagccttaaattcagttgtgcaatagccaggaatgtaaggaattcaaaattgttctttattttgtgccgccaataaatatcttttcataaaattagccagaaaagacgcggcatatagccctatttgcaccgatgatttcgcagcacgtgaggttaaaacttcctgattcatgtcacattttatggggagataatcgtaggctgacgacctttcagtcttctgtattagtcgtgtttacgagaattccctattaagcgaatgatgaaaagtagaacagtcgcaataagagcagggacttagtattgcactatctcctggaggtcaacagagggctattacatgcgcaacaggttaaagattgtgaatagttaccggcagtcatttacccgcttataacaagcgaggcagttgtaatgatagctcagaaggattatgcaaggcttcgtaagggagaacgcatataccacttctgtgcatactgttgagctgaaaaactgacgaattatgataaactccagccaactttatttcatatcattgagggcctgtggctgatggcacagctatatttctactattccgcaatgaatgcgggtaagtctacagcattgttgcaatcttcatacaattaccaggaacgcggcatgcgcactgtcgtatatacggcagaaattgatgatcgctttggtgccgggaaagtcagttcgcgtataggtttgtcatcgcctgcaaaattatttaaccaaaattcatcattatttgatgagattcgtgcggaacatgaacagcaggcaattcattgcgtactggttgatgaatgccagtttttaaccagacaacaagtatatgaattatcggaggttgtcgatcaactcgatatacccgtactttgttatggtctacgtaccgattttcgaggtaaattatttattggcagtcaatacttactggcatggtccgacaaactggttgaattaaaaaccatctgtttttgtggccgtaaagcaagcatggtgctgcgtcttgatcaagcaggcagaccttataacgaaggtgagcaggtggttattggtggtaatgaacgctacgtttctgtatgccgtaaacactataaagaggcgttagaagtcggctcattaacggctattcaggaaaggcatcgccacgattaataagaatttctttactgacagggtgagcagggcgcttttatcctgtcagttcgttttacgcacttcttccgggctatacacccttctcggcagttttttaacgccgctatacgcctcacagagcgcttatacaccgacattgacttgtaacctgtaaagtacaatatcgctgtgtgtaggcgttatacatcgtcgcaaatatgatgaaggacaatgctgccggtttatggaaaagttgttttgggaaaacaaaaaacggccccagaaggggtaatgccagtcagttaagcaactgactggctctttttcggggctgtggggtatttccagggcctctcctttaccactcttgggaaggccctttcccttcttgtcggtaatttcactggttgtcccatacttgcaagatcgcgcatcagctccggtatacgtcccggggaagcgtatggcgtccgtcatcgacgtcagcagatggcagacttttcctttgcgcgtcacggtcagcaggcgggctgtcacctcatttcccagtcccggccacttttttcgtgcctgcgggctgatgttcagcttcaccagatgatcgcctttacccagttttctgatctcttcatattgcgctccctttctgagagggatcatccagtggcggtgttctcccgccaggctccaggtatttaacagtcccagtgagtaataacctttgtcagggtgttatcgccggtttgttctataagttgctcagcaagctcatttccgctgttcttcatcgtgccgaaggctgcagtcgtcagcagatggctggtcagttccatctggcatgccattttgacctgcgggtagagcgccgggttcccggcatgtgtctggcgggggaaggcagcatcgttctctggtgtatccggtgtgcgccagaacacaccatcgatggccagcaggggcaggccgcaccagtgcggatgcggcgtggcgttatgccagagctgcgctgttttcgtgaacacgcggcggacagcctcacttcccagacgctggcgggcctgaataacggcactgggggcaacgaaggggcgattgcccggcagcatgatgtccaggtgattcacaatctggtgaagaggttctttacgctcaagcgccatgccaacaatacaccagaccgtcatttcgaggggaagacggcgcttgcgtagcgttacagtacctgattcggcaaggcaacgagagatgagttcggggtcgaggtaatcccccagagaagtcagtgggttacgcagagaatcgtaacgggataccaaatcaagggcctgcccaatgagcataaaaaaatccggaaacgagtgagcgtttccggattcttacacagccactggatcggtcaactgatccttaactgactggcattaccccagaaggggccgtttatgttgccagacagcgctactgattaagcggattttttcgcttttttctcagctttagccggagcagcttctttcttcgctgcagtttcgccttctacataatcacgaccgtagtaggtatccagcagaatctgtttcagctcggagatcagcgggtaacgcgggttagcgccggtgcactggtcatcgaatgcatcttcagacagtttatccacgttcgccaggaagtctgcttcctgaacgccagcttcacggatagatttcggaatacccagttcagctttcagcgtttccagccatgccagcagtttctcgatcttagctgcagtacggtcgcccggtgcgctcagacccaggtggtcagcaatttcagcataacgacggcgagcctgcggacgatcatactggctgaatgcagtctgcttggtcgggttgtcattcgcgttgtagcgaataacgttacaaatcagcagggcgtttgccagaccgtgcggaatatggaactgggaacccagtttgtgcgccattgagtgacatacacccaggaaggcgttcgcaaacgcgatacccgcgatagtcgctgcactgtgaacacgttcacgcgctaccggatttttagacccttcgtggtaggacgctggcagatattctttcagcagtttcagtgcctgcagagcctgaccgtcagagaactcagatgccagtacagaaacataagcttccatggcgtgagttactgcgtccagaccaccgaaagcacacagggacttcggcatgtccataaccaggttggcgtcgacaatcgccatatccggggtcagtgcatagtctgccagcggatatttctgaccagtagtgtcgtcagttacaaccgcaaacggagtgacttcagaacctgtaccagaagtggtggtgacagcgatcattttcgctttcacacccattttcgggaacttgtagatacgtttacggatatccataaagcgcagcgccagttcttcgaagtgagtttccggatgttcgtacataacccacatgatcttcgcagcgtccatcggggaaccaccacccagcgcgataatcacgtctggtttgaaggagtttgccagttctgcacctttacgaacgatgctcagggtcgggtcagcttctacttcgaagaagacttcagtttcaacgcctgctgctttcaatacggaagtgatctgatcagcatagccattgttgaacaggaagcggtcagtcacgatgagcgcacgtttgtggccatcagtaatcacttcatccagcgcgattggcagggagccacggcggaagtagatagatttcggaagtttgtgccacaacatgttttcagctcgcttagcaacggttttcttgttgatcaggtgtttcggaccaacgttttcagagatggagttaccaccccaggaaccacaacccagagtcagggaaggtgcgagtttgaagttatacaggtcaccgataccaccctgagaagccggggtgttaatcaggatacgagccgttttcattttctgaccgaagtaagaaacgcgagccggttggttatcctggtcagtgtacaggcaagaggtatgaccgataccgcccatagcaaccagtttctctgctttttctaccgcgtcttcgaaatctttagcacggtacattgccagagtcggggacagtttttcatgtgcgaacggttcgctttcatcaacaacggtcacttcaccgatcagaatcttggtgttttctggtacagagaagcctgccagttcagcaattttataggctggctgaccaacgatagctgcgttcagcgcaccgtttttcaggataacgtcctgaacagctttcagctctttaccctgcaacagatagccgccgtgggttgcgaaacgttcacgtactgcgtcataaacagagtcaacaacaacaacagactgttcagaagcacagattacgccgttgtcgaaggttttggacatcagtacagatgcaactgcacgtttgatatcagcagtttcatcgataacaaccggagtgttgcccgcgcctacgccgatagctggtttaccggagctgtatgcggctttaaccatgcccggaccaccagtcgcgaggatcaggttgatgtctgggtggtgcatcagtgcgttagacagttcaacagaaggttgatcgatccagccgatcagatctttcggagcaccggcagcgatagcagcctgtagaacgatatcagccgctttgttggttgcatcttttgcacgcgggtgcggggagaagataatggcgttacgggtcttcaggctgatcagcgatttgaagatagcagttgaagtcgggttagtggtcggaacgataccgcaaataataccgatgggttcagcgatagtgatggtaccaaaagtgtcgtcttcagacagaacaccacaggttttttcatctttataagcgttgtagatatattcagaagcaaagtggtttttgatcactttatcttcgacgatacccatgccggattcggcaacggccattttcgcgagtgggattcgagcatctgcagcagccagagcggcggcgcggaagattttgtctacttgctcttgagtgaaactggcatattcacgctgggctttttttacacgctctacgagtgcgttaagttcagcgacattagtaacagccataatgctctcctgataatgttaaacttttttagtaaatcatctgctcgaatacgagagtatagtcagtgcggtgatgatttgcttaaccgatggaaatcaaaagcttactcgcgctcacactcactgtgatttactaaaagagtttaaacattagagttattatctctaatgcgtcacttccaggtggcgtaagcaagattactcacttctgggtactgattacgtgatccaaatcaaatttttgcaaagctgacacctttcagcatggcttttcgccattatagctaacagttaataaattgtagtatgatttgttggctacattagcatgttttgcacaactagataacaataacgaatgatagcaattttaagtagttaggaggtgaaaaatgctgtcaaaaggcgtattgtcagcgcgtcttttcaaccttatttatggctaacattatccggcttttgcttcggagctaaccgtgattcagaccctttttgattttcccgtttacttcaaatttttcatcgggttatttgcgctggtcaacccggtagggattattcccgtctttatcagcatgaccagttatcagacagcggcagcgcgaaacaaaactaaccttacagccaacctgtctgtggccattatcttgtggatctcgctttttctcggcgacacgattctacaactttttggtatatcaattgattcattccgtatcgccggtggcatcctggtggtgacaatagcgatgtcgatgatcagcggcaagcttggtgaggataaacagaacaagcaagaaaaatcagaaaccgcggtacgtgaaagcattggtgtggtgccattggcgttgccgttgatggcggggccaggggcgatcagttctaccatcgtctggggtacgcgttatcacagcattagctatctgtttggtttctttgtggctattgcattgttcgctttatgttgctggggattgttccgcatggcaccgtggctggtacgagttttacgccagaccggcatcaacgtgattacgcgtattatggggctattgctgatggcattggggattgaatttatcgttactggtattaaggggattttccccggcctgcttaattaattcctttcaaatgaaacggagctgtcatgctccgtttacttcgtcattatttttactttgttcctgcgcagttatcaaaagcaaaaggaataggtaaaaatattcttctcaaattacagttagttataaggatttccttaactgcttctcctcaccatcatgttattttcgccacatcataatcctgggcttgctgaagaataattgaaatgatattagtaattccactgcctttggtagaggaaagtgctaaataataatcaattgttaaattattgtgcatttcactactggaactgtaatcagaaaagagagacatgcttaaccaacctctatttgattgaattgaaagatgtttgttaaggcatggatgcaagctatagattctggttcggtcaataaaagagaattgcttaacaattttgcaaaatgtattggcgagtaagaaccgcatttggtactttccgggcaaccgccaggcgattctttattggtaatgagaataattaacaattaaagatcgtcgcgaaagaataatgtgtctcgacaggggagacacagtacgaatcgacataaggtgatcgtctgaatcaccagaataaataaagtcggtgatagtaatacgtaacgataaagtaacctgacagcagaaagtctccgagcctgtgcagggtcccaatccgggattacacatgctggttaataccagtaattataatgagggagtccaaaaaacaatgaccaacatcaccaagagaagtttagtagcagctggcgttttggctgcgcttatggcagggaatgtcgcgctggcagctgatgtacccgcaggtgtcacactggcggaaaaacaaacgctggtacgtaacaatggttcagaagttcagtcattagatccgcacaaaattgaaggtgttccggagtctaatatcagccgagacctgtttgaaggcttactggttagcgatcttgacggccatccggcacctggcgtcgctgaatcctgggataataaagacgcgaaagtctggaccttccatttgcgtaaagatgcgaaatggtctgatggcacgccagtcacagcacaagactttgtgtatagctggcaacgttctgttgatccaaacactgcttctccgtatgccagttatctgcaatatgggcatatcgccggtattgatgaaattcttgaagggaaaaaaccgattaccgatctcggcgtgaaagctattgatgatcacacattagaagtcaccttaagtgaacctgttccgtacttctataaattacttgttcacccatcaacttcaccggtgccaaaagccgctatcgagaaattcggcgaaaaatggacccagcctggtaatatcgtcaccaacggtgcctataccttaaaagattgggtcgtaaacgaacgaatcgttcttgaacgcagcccgacctactggaacaacgcgaaaaccgttattaaccaggtaacctatttgcctattgcttctgaagttaccgatgtcaaccgctaccgtagtggtgaaatcgacatgacttataacaacatgccgatcgaattgttccagaagctgaaaaaagagatcccggacgaagttcacgttgatccatacctgtgcacttactattacgaaattaacaaccagaaaccgccatttaatgacgtgcgtgtgcgtaccgcactgaaactgggtatggaccgcgatatcattgttaataaagtgaaagcgcagggcgacatgcccgcctatggttacactccaccatatactgatggcgcaaaattgactcagccggaatggtttggctggagccaggaaaaacgtaacgaagaagcgaaaaaactgctggctgaagcgggttataccgcagacaaaccgttgaccatcaacctgttgtataacacctccgatctgcataaaaagctggcgattgctgcctcttcattgtggaagaaaaacattggtgtaaacgtcaaactggttaaccaggagtggaaaacgttcctcgacacccgtcaccagggcacttttgatgtggcccgtgcaggctggtgtgcagactacaacgaaccaacttccttcctgaacaccatgctgtcgaacagctcaatgaataccgcgcattataagagcccggcctttgacagcattatggcggaaacgctgaaagtgactgacgaggcgcagcgtacagctctgtacactaaagcagaacaacagctggataaggattcggccattgttcctgtttattactacgtgaatgcgcgtttggtgaagccgtgggttggtggctataccggcaaagatccgctggataatatctacacccggaatatgtacattgtgaagcactaatggcaatacgtggggcaggagtgtcctgctccacggtgtctgatttttatcgcattacagaaggcacaggccagaaggtagggcaatgttaaaatttattctacgtcgctgtctggaagcgattccgacgctatttattcttattactatttcgttctttatgatgcgcctcgcgccgggcagtccttttaccggcgaacgtactttaccaccggaagtgatggccaatatcgaagcgaaatatcatcttaatgatccgatcatgacacagtatttcagctacctgaaacaactggcgcatggcgatttcggtccatcgtttaagtataaagattattcggtcaatgacctggttgcatccagttttcccgtttctgccaaattgggagccgcagcattttttcttgcggtaatactgggtgttagtgctggcgttattgccgcattaaagcaaaacaccaaatgggactataccgtgatggggctggcaatgaccggggttgttatccccagttttgtggttgcgccattattagtcatgatatttgcgatcattttgcattggctgccgggcggtggctggaatggtggagcgcttaaattcatgatattgccaatggtggcgttatcactcgcctatatcgccagtattgcgcgtattacccgtggctctatgattgaggttttacactccaactttattcgtactgcccgggcgaaagggttacctatgcggcggatcattttacgccacgcattaaaacctgctctgttacccgtgctctcctatatggggcccgcatttgtcggcattattaccggttcgatggtcatcgaaaccatttatggtttaccggggattgggcaattgttcgttaatggcgcattgaaccgtgactattccttagtgttaagtctgaccattctggttggcgcgttaaccattttgtttaatgccattgtcgatgtgctatatgcggttatcgacccgaaaatccgttactgatactggagctcgcgatgatgttaagtaagaaaaacagcgagacgctggaaaatttcagtgaaaagctggaggtcgaagggcgcagcttgtggcaggacgcacgtcgacgttttatgcataaccgtgcggcggttgccagtctgatagtgctggtgctgatcgcgttatttgtaatcctggcaccgatgctttcgcagtttgcctatgacgatactgactgggcgatgatgtccagcgccccggatatggagtccggtcactactttggtactgactcatccggtcgcgacctgcttgtgcgcgttgcgattggcgggcgtatctcactcatggtcggtgttgctgcggcactggtggcagtggtcgtggggacactttatggttcgctttccggttatctgggcggtaaagtggattcggtaatgatgcgtctgctggaaatcctcaactccttcccattcatgttcttcgtcattttgctggtgacctttttcggtcaaaacatcctgctgattttcgtggcgattggcatggtttcctggctggatatggctcgtattgtgcgtgggcaaaccctgagtctgaagcgcaaagagtttattgaggcggcacaagttggcggtgtatcgacgccgggcattgttattcgccacattgtgccgaacgtactcggtgtggtggtggtctatgcgtcgcttctggtgcccagcatgatcctctttgaatctttccttagcttcctgggattaggtacgcaagagccgttaagcagctggggtgcattgctgagtgatggcgcgaactcgatggaagtctctccatggttactgttgttccctgcgggattcctcgtggtaacgctgttttgtttcaactttatcggcgatggcttgcgtgatgccctcgacccgaaagatcgttaaggagtgcagccatgagcgtaattgaaactgcaactgtgccgctcgcacaacaacaggctaacgcactgctgaacgtgaaagatttgcgtgtcacctttagtaccccggatggcgacgtcacggcggtcaatgatttgaatttttcgctacgtgccggagaaacgctgggcatcgtaggtgagtctggttcgggtaaatcgcaaactgcatttgcgttgatgggcctgttggctgccaacggacgtattggcggatcggcaaccttcaatgggcgtgaaatcctcaatttgccagagcgtgaactcaataaactgcgcgctgaacaaatctcaatgatttttcaggacccaatgacttcgttgaatccctatatgcgcgtcggtgagcagttgatggaagtgctgatgctgcataagaacatgagcaaagctgaggcgtttgaagagtcggtgcggatgctcgatgcggtaaaaatgccggaagcacgtaaacgcatgaaaatgtacccgcatgaattttctggtggcatgcgtcagcgagtcatgattgcgatggcattgctatgtcgacctaagctgctgattgcggatgaacccactactgcgctggacgtcaccgtacaggcgcagatcatgacgctattaaatgaactgaagcgggaatttaataccgccatcattatgatcacccacgatcttggcgtggtggcggggatctgcgacaaagtgctggtaatgtacgccgggcgcacgatggaatatggcaatgcgcgcgatgtcttttatcaacccgttcatccttattctatcggtttgctcaacgcggtgccgcgtctcgatgcggaaggtgaaacaatgttgaccatcccgggtaatccgccaaacttgctgcgattaccgaaaggttgcccgttccagccacgttgtccacatgcgatggaaatttgtagtagcgcaccgccgctggaagagtttacgcctggccgtctgcgtgcttgctttaaaccggtggaggaactgttatgaatgctgtaactgaaggaagaaaagtcctccttgaaatcgccgatctgaaagtgcactttgaaatcaaagatggcaaacagtggttctggcaaccgccgaaaacgctcaaagccgtcgatggtgtcactcttcgcctgtatgaaggggaaacattaggtgtggtaggggaatcgggatgcggtaagtccacctttgctcgcgccatcatcggtttggtcaaggcgaccgacggtcatgttgcctggttaggtaaagagttgctgggcatgaagcccgatgaatggcgtgccgttcgcagtgatattcagatgattttccaggatccgttggcatcgctgaacccgcgtatgaccatcggcgagatcatcgctgaaccactgcgtacttatcatccgaaaatgtcacgccaggaagttcgcgagcgcgtgaaggcgatgatgctgaaagtcgggttattgcctaacctgattaaccgctatccgcatgagttctccggtgggcagtgccagcgtatcgggattgctcgtgctcttattcttgaaccgaagctgattatctgcgatgagccggtttcggcgctggacgtgtcaattcaggcgcaggtggtcaacctgctccagcagctgcaacgtgagatgggattgtcattaatttttatcgctcatgacctggccgtggtaaaacacatttccgatcgtgtgttagtgatgtatctcggccatgcggtagaactggggacctatgatgaggtctaccacaatccactacatccttacaccagggcattgatgtcggcagtccccatacctgatccggatctggagaagaacaaaaccatccagttactggaaggggaattaccgtcgccgatcaacccgccttccggttgtgttttccgtacccgttgtccgattgccggtccggagtgtgccaaaacacgtcctgtgctggaggggagtttcagacacgccgtttcttgcctgaaagtcgatccgctttaaacacaataagggctgacagttgtcagccctttttcacgccaaaagcgattatttattcccgccagatgatatggcaaagtttgtgatctttttcgcggcataacagaatacgcgcgaaaacatcgttgatttcaccatcttcactgtccgccagaccaatcaccacttcggcaaaaaagtccgggttcaaatcgaaatcaacatgttcctgccagtcttccgccggatcgaataactccgcgccgccgcgctcttcaaactgaagattgaacagcagaacatcagctggatcgagattgtcggcagctagttcgagaaaaatatcgtaggcctgctcaagcgtttcatcttcagtcaggcgattgtttagatccatatccatagtcactacctgtttaacctctgttggcgacgttttacagcaacgggctgaagaagtaaaacagtcgctcggcgacacgttgccataatggacgttttagccataaacgggcatcgagcagacgagaacgcgaaatataatcgtcctgaacggcggcgaggtctgcaccaaaacctttatcgtcgattgccagggtaatctcgaaatttagccacagactacgcatatcaaggttaacggtgccaaccagacttagttctccatcgaccagcacgctcttggtgtgcagtaacccgccttcaaactgataaattttaaccccagcagccagcagttctgtaaagaatgcgcgactggcccagccgaccagcatcgagtcattttttcgcggaaggataatactgacatccaccccgcgctgcgccgccgtgcaaatcgcatgaagtaaatcatcgcttggcacaaaatagggcgttgtcatgatcaaatattcacgagccgaataagcagcagtcaataatgcctggtgaatgagatcttccggaaagccggggccagaagcaattgtgtgaatggtgtgaccgctggcctgctcaaacggcataatattgacatctggtggcggcggcagaatacgtttcccggtttcaatctcccagtcgcaggaataaataatccccatcgcggtggcgatggggccttccatacgcgccatcagatcaatccattgccctacgcccgcatcttgtttgaagtagcgagggtcgaccatattcatgctgccggtgtacgcgatgtaattatcgatcatgatcatcttgcgatgttggcgcaggtccatacggcgtaaaaacacacgcatcagattgacctttaaggcttcgacaacttcaataccggcattacgcattagctcgggccacgggctgcggaaaaaagccacactcccggcggagtcgagcatcaatcggcaatgaataccacgccgtgcagcggccattaatgattcagccacctggtccgccatgccgccgggctgccagatataaaacaccatctcaatattatggcgcgcgagctggatgtcgcggattaacgcctgcatcacatcatctgactcggtcatcagttgtagctgattccctttgaccccagcgatcccctgacgacgctcgcaaagcttgaataatggcgcagcgacactgctattttcttcggcgaagatatgcttacaggctttaaggtcgttaagccattttgcggtggaaggccacatcgctctggcgcgctcagcgcggcgtttgcctaaatggagctcgccaacggcaagataggcaataattccgactaacggcagaatgtaaataatcaacagccaggccatcgcggagggaactgcgcgtcgtttcattagaatgcgtaaagttacgcctgcaatgagcaaccagtatcccagaatggccaaccaactcaccaacgtataaacggttgtcatagattagaaatccttttgaaagcgcattgttatgagtttacgcatatggattcatctggcaaataaaaacgcgggaaaagcactggtcagcgtcaggggcgggggtataatgaccattctgttgttgcatagagtagttaacatgaagcggagtagaacggaagtggggcgctggcgcatgcagcgtcaggctagccgacgtaaatcgcgttggcttgaggggcagtcgcgccgaaatatgcgtatccacagcatcaggaagtgcattctaaacaaacagcgtaactcgttattgtttgcgatctacaatatctaaatgtactgggcaccattgcggtgcccaataagtttactcttccgtctttaaactctatttttgcgccgattctttactgtcagctttcgtttcttgttcatcgttatcgctgaaaatgccatgaccggagttcaacaacattgaaacgagcatatcattattaatctcttcaccatttaaaactcgcgccagaatttcgctgccaaacagttgtggtgagagaatgatatccggatgtaccatcttaatcttattcaggtttttgctatcactgacggcgagaactgttttgacatcactgctcatatcttttgccgagagtacaacaaacgcgttatctgcatcgttatcactcagcgccagaatggcccggcaacgatcgattcccgctttctttaacactgaactgtcattactgtcaccggggataacatcggcgttatcgcctaagcgttgctcaagttgcttgatatcatcttcaggcaagttgctgataaccgttacgttttgtccgcgttgattcagttgcagaatcgtattgatggcgagaatcgaatgtccgcaaacaataaaatgatctttacgatgcattgtatgattgtttccttttacaagtttgttgaatcccccacggataagcggaccaaaaattgaggtcatagatgtggcaaaaacggtaatgccggaaataatgaccgaaatagtgaacaatcgtgctgattcagaaacagggacaatatcgccatagccgacggttgacatggtttctatcgaaaaatagaacgcggtcatcaaactttctattcgcggattaaaaccttcgcttaaataaagcgcaccgtaagtggagtaaaacagtaacgtcgtgaaactaataaatgcgaaaattgtcccggctgctgcgctactgtgggagaagtctttgcgcagtatcagcaaaaacaccagcgtaaaaatgcaaaatccaatactaaatttcagccagggataaaaatgcagagtgtaaattagcgctatcaacaacaaaatgatactgattgcccatgcgagctttgcccggaacagtaagccaatggagttcaggacaagaaatacgccgagcataaatagtggggcgtttgccagcaaggagagatccagctctgaaaatgctttgatatggaaaatatcaagcaaattgaccgacataccatagattgttttaaaaataagcaatccatttaaaaagacggccagcgcgagaatgtcgtgccgtagggtcacccataactttgttgctgtttgtttgaatgtagtccagtgactcactgatacctctgtaaccacaattttgtttaattatctcaacgtgcacattttctgaacatacatgcagcgcgtgaatgtgttaaacaatagtagatgactttatccgcagtaatcaaaggttttgagtgagcaactctgcgtcaggaaagggcattttcctgaatatgttcacatcatataaagaaatacagataaagttattatctgcttgtggtggtgaatgcactgaccgacctataaggaaaggccaaacaagaacacggttgcaaaaaccgtgcccttaaatattgaatttctattcagaacactttcttaaatggtttcactgaaacgtgttcatagactcctgccgctacgtacgggtcagcatcggcccaggcctgagctgcttccagcgactcaaattcagcaataacggttgagccagtaaatcccgcagcccctggatcgttactgtctaccgctggcattggaccggcggtcaacaaacgaccttcatcatgcagtaactgtaaacgtgctaaatgtgccggacgaacggaaaggcgtttttcgaggctatcagctttgtcttgagcgtaaataacatacaacacgggcacaactccttgttcgggaaagttgtaaagtacgttatttgaaagggcgaagatctgcaacggaaagatgatgtctttgttaagaccatgcataaagtaaggtcaattacgccaaaaatgacattttcactgatcctgatcgtcttgccttattgaatatgattgctatttgcatttaaaatcggggcctggtttttctactgaaatgattatgacttcaatgacccttgatttacctcgccgcttcccctggccgacgttactttcggtctgcattcatggtgctgttgtggcgggtttgctctatacctcggtacatcaggttattgaactacctgcgcccgcgcagccgatttctgtcacgatggttgcgcctgctgatcttgaaccgccacaagccgttcagccaccaccggagccggtggtagagccagaaccggaacctgagccgatccctgaaccgccaaaagaagctccggtggtcattgaaaagccgaagccgaaacctaagccaaaaccgaagccggtgaaaaaggtggagcagccaaaacgcgatgtcaaacccgtagagtcgcgtccggcatcaccgtttgaaaatacggcacccgcgcgcccgacatcaagtacggcaacggctgcaaccagcaagccggttaccagtgtggcttcaggaccacgcgcattaagccgtaatcagccgcagtatccggcacgagcacaggcattgcgcattgaagggcaggttaaagttaaatttgatgtcacgccagatggtcgcgtggataacgtacaaatcctctcagccaagcctgcaaacatgtttgagcgtgaggtgaaaaatgcgatgcgcagatggcgttatgagccgggtaagccaggcagtgggattgtggtgaatatcctgtttaaaattaacggcactaccgaaattcagtaagcataaagtcaaaagcctccgaccggaggcttttgattattactcaacgggtaaggcgcgaggttttccttcgggatcaaccgcgacatacttaaataatgcttctgttgctttatagcgttgcccgattggttcagacgccacttttttcacccacacttcaatattaatgctgactgatgtcgtccctttctggacacagcgtgcatagcagcacaccacatcgccgaccgcaaccggccgtaagaaagtcattccttcaacccgcacggtcactacacgaccatgggcaatttctttcgccagaatagcgccgccaatatccatttgtgacattaaccaaccaccaaagatgtcaccattggcattggtatcggcgggcatggctaaagtacgtaaaacaagatcgccctgagggacgttatgtgttgtagacatggtaaaaccgacttaaaaggaaaatcacaggcgcgatgctactatgattttcctgaggagaacagaggagatacagcgccagcccctgaaggactggcagtctggttaggatttatcttcctgcggcatgtggcggtagatatagataccgcttaacaatgtgaagattaaggtaagggcggtcaggccaaagactttaaagttgacccaaatattttgcggcagccagaatgcgatgtagatgtttgccagaccgcaaaggataaagaaaacagcccaggccagattcagcttcgaccataccgattgcggcagggtgagttctttacccagcatccgctgaattagcggctttttcatcacccattggctgactaacagggcacccgcaaacagggcataaatgacagtaaccttccatttaataaactcatcattgtggaagaacagcgttaagccaccgaagacgaccaccagaacaaaagtgatcagggccatcttctcaaccttacgaaagcgaacccagctatatataagcacaatcgccgtggcgacgatgagcgccgcagtagccgcatagatgtcataaatcttgtaaaacgcgaaaaagacaaccagcggtaaaaaatcaagaaactgcttcattttacgattccgtaatcaaatgcttaaggttattggcgaatcaacatatacaggcggaacagatagatgagcaatacggctgaaatcaggttgctcaaggtgttcgccagtacggcaccaatttccggggttaatgcggcaaaagaagaggcaaaaagcagcaacagtgtttttgccagcaaccagctcagtactgcgggtgccaccagacgcatattcgcccatgtcagccgcatactgctacgcatcgaggcaaaaacgcccattttgtcctgtaccagcatcactggagccagagccagtaaaatggccatgataatccccggaacgaccaccagcatgatgccaatctgtactaaaagggtagtcagaaaaatcagaataaataactttggcaatatcggcgcactggcaccaatagctcgcagcgcactgactctctgacccgcagacaccagctggataattaatattacgcccccggcgagaatggcgttaccgattaatcctgaaaaagtggacgccgctgaagcctgcagcaaaatttgttgctgttccggtgacatattctgaaccaggtcgaacaacccactactgccgctaacgggtacgccgtcattgagctgcgcaagctgtgcatcactgggtgagaaaacatgccctaacaccactgtgataaacgcacatagcaacgataccaacagaatggtcataaattgattacggaagaaatttccggtgtcacggtatacggactgcgccgtgatagacatgcactctccttgagttttatgcaggtgttaattagcgggcaattgtaccctggttaagccccgggtggcagcatcaggtcttgtatggaaaagcatatctttgtaaagcggaggtaattgctggccttcaggcgtgggtaaaccgctgcaagtggcgagcgagttaatatttgcgtagcgaaaatataaaaattgatttaaatcacattaacctggattttcaatgcaacttctaaattaatccagatcaataaagggtgaattaccatatgtaatgtgatctgtgtaggatcatttgttaccccaatgtgggtatattcgtcacgtttttataaccataacgacggagcggatatgaaaaagttaacagtggcggctttggcagtagcaactcttctctctggcagtgcttttgcgcatgaagccggcgaattttttatgcgtgcaggttctgcaaccgtacgtccaacagaaggtgctggtggtacgttaggaagtttgggtggattcagcgtgaccaataacactcaactgggcctgacgtttacttatatggcgaccgacaacattggtgtggaattactggcagcaacgccgttccgccataaaatcggcacccgggcgaccggcgatattgcaaccgttcatcatctgccgccaacactgatggcgcagtggtattttggtgatgccagcagcaaattccgtccttacgttggtgcaggtattaactacaccaccttctttgataatggatttaacgatcatggcaaagaggcggggctttccgatctcagtctgaaagactcctggggagctgccgggcaggtgggggttgattatctgattaaccgtgactggttggttaacatgtcagtctggtacatggatatcgataccacggctaagtacaaatctggtgttactaccgtaaaagactcggtacgactggatccgtgggtgtttatgttctccgcaggatatcgtttttaattttctctgcaaaacctctgcaaaacccctctgcaaaactggtcatcaaatgaccagttttttccattccttaccgcgtgcgtcgttgtaaatatcggtcattttttgatgcgaatggcctagcaaaattttggtatcaaccccctgctctctgaacaatcgctctgataaagatctctgctcatggaaagagggaggggtgccattagcacgccagttgtaatccacagaatcccgggcttttttaaatgcaacggttaatgttgctggcttaaccatcccgccgcgcttagctgtccctttcgcgtgatggtggtgcaatagccacggactaagaacgcaatcgcggcaggatgacaccacatcatccagggtgagatttaatttatcgcaacgcagagccagagggatggcaatccgggttcctgttttttgctgttcgacatgaagataaccatcccggatatccgaaaattgcattttgcaaatatctgaaaggcgctggcctgtcatcagtgccagcagcataccgcgctgtaaaaagtaaccatccttttccgctgcgttataaatcatcatccactcatcaaaagtcagtcgctgtcttgatatccgcacctgcggtttttttgccgattctgcagggttaaagcctggcgggacatcgcccgtttgctgagcttcccggaaaacatcgatcagtactttcctgaaaatttgtcccattctgttatgtcctctggccttgtactcttccagtactgataccacatcttttacggttatggcatctaacggtctggtgccaaaacgttcatcaaataccctgagaggggccgctttctgtttcagcgtgttgagtttgatctcgccgttttcatatctttcctgttgaatttttctgtaattattcagaaaaatggtaacggttgatgaaccgccggtatcactaataattttctcctgcagactgagcatttgttccatttgctgccgggcaagacggctgttcgcttctgctgcaatagtttctgccagtttctggtcaatactgccgagaccgtgatttttgcctgttatgggatgcctgtaacgccagtaaactttgttatttcttttgtcaaaatacggagataatcccggaacatcggttttatattttcgcgggcgcgccatcttccagtatcctcttcaaagcagggtgatctgtggcgatcacctccggcttgtttaccattccgacaaagcgagcttgcggatccactcgccagcgtcttccaacttttttggggagaggaaatatcattccggctttagcgtatttacttaacgtactcggagttgggaccggttcactgaattcctcttttgcccactcagtgagcagaataagtcttgccatgagcgtcgttcgctaatcatggtcgccgccactatagctggtgggcaacgaccggggttgaacattaaaaatcagcctgattcgggatcagtttttgccagataactgaaacgtattttgcctggtaacgggcgtcatcaagtgcattatggcgctcaccttcgaatggaatagccgttctggcatcgaagtctatggctttccccagctcaacgattgtgcgtacatcgcgatcgttgtagtaacgccacgggcaggggatcccctgccgttcgtatgaacggcgcaaaatcgtgttgtcgaagttggctccatttccccagacctgaacaaaaaattcaccggagttttcgtcgataaattcccgcaattgtaacagtgcatcatctaacgggatttcatcggtcataaggtaatgactccaacttactgatagtgttttatgttcagataatgcccgatgaccttgtcatgcagctccaccgattttgagaacgacagtgacttccgtcccagccttgccagatgttgtctcagattcagattatgtcgctcaatgcgctgagtgtaacgcttgctgataacgtgcagctttcccttcaggcgtgattcatacagcggccagccatccgtcatccataccacgacctcaaaggccgacagcaggctcagaagacgctccagtgtggccagagtgcgttcaccggagacgtgcgccacaacagtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtaccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattacccgacgcctgatgaaatacatgacgaagcaaaagatattttctttaactactgcaattactcatatcacgaaataaaagacgaagaggaagagcaaaatggctgattttggttcaactaaatacaacgtcagttttgaagcatggcatgaactgttaatggactatgcagagttacgtggtggcagtgctgctgatgctgaagcatggcgtgatgattatgaagcaggaaaaactccggtcgaagcatattgtgatgagtggggcgatgaatgagcgagattaattatcaggaagggcatgaaacggcagggcaggcaaaaccagttgcatggcgatatcgctacgtgaaaaaagacgttacagactttcaggggaagccgtgggctggtgactggaaatatgtaccgacaaaagaggattgtaacgacaggccgaactatgaaattcaggccttattcatcggcccgccagtcccggtgacatcagaaggactggttaaagccgtgcgcttttatgaacaggtaaagcgtgagaatccgccagtcgaaacaggagcatggaaggatgctgttgactgggtgctcagagaggcctgctgcgctgccattctgggtaaagccgacaatccaccagcatccggcaatcaggttagcgaattaacaatgtgggttaaacgactggtcagtcaactgaaaaaagctcagccggactgcaaattaccggagaaggcgatggattacctgaaacgaaatggactgataagcgtggaggatgttttacgatgaatatttagactaaagagtttgtaacgctatgtaagtgattttttctggtttagatatttatatgtccggccaaattgaggtgtgtttaaatgttattgcacattgattgtagggggaataatgaaaaacgcattgcagtttttgtttgttgcgttctggttgttcgcatcatgtatgcccatcatcttcacagcaaggtatatggaaaaaattgatgttttgatattaatgtttggacatataaatgccctttttttaggggtgttcatggcggtcatgtgcattgaatactggcggtaaatacagcgaacgccattggtttagttggatatttactgtgccggacaaaaacggtttgcggggaaatcttagttaagtagaataactgcgggtgcttgaggctatctgtctcaggcatgaacaccaaaaggcagatagagaaaagccccagttaacattacgcgtcctgcaagacgcttaacattaatctgaggccatatctatgcgacacatagagattagcctcttacggaccgaaaggtcaaggagaagcaggctatgaagcagcaaaaggcgatgttaatcgccctgatcgtcatctgtttaaccgtcatagtgacggcactggtaacgaggaaagacctctgcgaggtacgaatccgaaccggccagacggaggtcgctgtcttcacagcttacgaacctgaggagtaagagacccggcgagggataaatccctcgccacctctgatgtggcaggcatcctcaacgcacccgcacttaacccgcttcggcgggtttttgtttttattttcaacgcgtttgaagttctggacggtgccggaatagaatcaaaaatacttaagtagcgcgcagggataagagggatggtcccttaaaggggagagctaattatccggaaggattctgatgatgaacatcgaagaactgcgtaaaattttttgtgaagatggcctctatgctgtgtgcgttgaaaatggaaacattgttagtcattaccgcattctgtgtttgcgaaagaatggggctgcgttaattaattttgtggatgctcgggtcacggacggatttatcttgcgcgaaggtgagtttgtcacttcattacaggcactgaaagagatcggaataaaagcaggcttttcagcttttgcagaagaataaactcatctacaatcttgcgcggggctgaactcccgctgagtaacaccgtgccaccggagaaaaccgatggcacgcaacgtaaaatattacaaacatgataattcgaccgttcttgcccacacgcacgagcggtattctcacgcattcaagtctgaatggttccagcaccctccatgcactgaagagcaggctgaatggataattcagtgttaccgcaggcgcggatacgaggttaagaaagcccttagtctcgactaccgtcactggataatctcagtcaggcttccttactccgaacgcccaccgcgtctgtcccgcacattccagcaacgcatctggaggtaacgtgcgggtattacttcgacctgttctggtaccggaactcgggctggtgatcgttaagccgggccgtgaatccatgccggtattccacaatacccgggtactggtggagccggaaccgaaaagcatgcgtaatctgccgtccggggtcgttcctgccgttcgccagccgctggcggaggataaatcattactgccatttttcagcgacgaacgagtgattcgtgctgctggtggcgctggcgcattgtctgactggttactgcggcatgttaaatcctgccagtggccacacggcgattatcaccacagtgaaaccgtcattcaccgttatggtaccggcgcaatggtgttgtgctggcactgcgacaaccagctgcgtgaccagacatccgaatcactcgagcaacttgctcatcaaaacctgtcagcatggatgattgacgtcatcggtcacgcaataagcggtacgcaggagcgtgaattatctctggctgaattatcctggtgggcggtccgcaatcaggtggcggacgcgctaccggaagcggtattacgtcgttcgctggggttgcgtgcggaaaaaatccgctcaatgtaccgtgaaagcgacatcgtaccgggagagcagaccgccaccagcatactgaaacagcgcacaaaaaatcttgcgccgctgcctcacgcccaccagcaacagaacccaccacaggaaaagacggtggtcagcattgccgttgatcctgagtctccggaatctttcatgaaacgacctaaacgtcgccgctgggttaacgagaaatacaaacgctgggtgaagacacagccgtgtgcgtgttgtggtcagccagccgacgatccccatcacctgattggtcacggtcagggagggatgggaacaaaggcccacgatattttcacgctaccgttgtgccgggaacatcacaacgaacttcatgcggatccgctggcgttcgaagaaaagcatggttctcaggttgatttaatttttcgttttcttgatcacgcctttgcaactggcgtgcttgggtaaaagaggtgactgatgctcatagatttggttttaccttacccgccgacggtgaacacttactggcgacgccgtggcagcacatattttgtatcaaaagccggggagcgttatcgccgggcagtggcgcttattgttcgccagcagcgcttgaaattaagcctgtccggacggttggcaataaaaattattgcagaaccaccggataagcgccgccgtgacctggacaatattctgaaagcgccgctggatgcgctgacgcatgcggggttgctaatggacgatgagcagtttgatgaaatcaatatcgttcgtgctcagccagtatctggtggacgtctgggggtgaagatttaccccataatgcttgaagggcaggtcaaaaaatgaaactggaagatttaccgaaatactactccccaaaatcccccggcctgactgatgcatcggcctcaacgtcgaaagatgcgctgagtatcactgatgtgatggccgcgcagggcatgacacagaatcgggctgagatggggttttctgcgttcctggggaaaatgggcattagtatgaatgacagagagcgggcaacagaattgctgacagaatatgcactcagtcggtgcgatcgtgtggcggcgttgagaaaacttccggcagaaataaaaccggtagtgatgcgcattatggcttcgtacgcttttgaggattatgcccgcagcgcagcgagtaaaaagcagtgcccctgttgccgaggggaaaaatttattgaaggcgaagtttttacaaacaaggttcagtatccggatggcaagccgccagtatgggcaaagtgtacgaaaggtgtgtatccgtcttactgggaagaatggaaaaaaattcgggaggtggtgaaagtttcttgtcctgaatgtaaagggaagggggagatttccactgcctgtaaagactgccgtgggcgtggtgtcgccattcatcgtgaagagtcggtaaaacgtggtatgcctgttatcagagactgccagcgttgtggtggtcgtggctgtgaaagactaccatcaacggaggcatttaatgccatacgcaaagtgacgagtgctatcacgcttgatacgtggaaaaaatcagtgaaacgcttttacgatacgttggtggttcggtttgacattgaagaggcatgggcggagcggcagttaaagagggtaacgcgatagtgttgttgatttttcccgaatctgtggtaaatttgccctaacgatgggcgttttatgcctgacgttagaagattttttacaccccgccgcctggcgggttttttatgactgaaatcgcgtcagtacagtaaacgcgctggtggcggtgaatacctgtctttcagcttgctggctttttcgacaagagttattggtgtgtcacgttaaccggaaaagggaaaaagacatgctgaaacagcaggatatgaccgaaaccgccagagtggtgtttaatgaattaagtgccaccgaaccggcgacagtcggggagattgcgcagaatacttacctttcacgtgaacgctgccagttaatactgacccagcttgttatggcgggactggcagactatcagttcggttgttacagacgccttcagtcctgaaggcttttttatttgtggtaaatgggcggctggtgggtgttaggggcactcaccagccatctgctcatgcgtccggatcacaagcaaacctcaggcccactgctttgcgcaaaagcagaatgagcctatcagagacaggcttaatgatccatgcttaatactgtaaaaatatccagttgtgagttaatcaacgccgactgcctggaatttatccggtcgttacccgaaaattctgttgacctgatagtcacggacccgccgtactttaaagtgaagcctgagggctgggataaccagtggaagggcgacgatgattacctgaaatggctggaccagtgtctggcgcagttctggcgggtgctgaaacctgccggaagtctttacctgttctgtggccatcgcctggcgtctgacattgaaatcatgatgcgtgaacgcttcaatgtgctgaaccatattatctgggcgaagccgtccggacgctggaacgggtgcaacaaggaaagcctgagggcatatttccccgccacagagcgcattctgttcgcggaacattatcaggggccgtatcgcccgaaagatgccgggtatgaggcgaagggcagggcactgaaacagcatgtgatggccccgctgatttcttactttcgtgatgcgcgtgctgccctggggataacggcaaaacagattgctgatgccacaggaaagaaaaacatggtgtcgcactggttcagtgccagccagtggcagctaccggacgaaagcgattatctgaaattacaggcgctgtttgcccgggtggcagaagagaagcatcagcgcggagaactggaaaagccacatcaccaactggtcagcacatacagtgaactgaaccggtagtatacggaactgcagagtgaatataagcatctgcggcggtattttggtgtgacggtgcaggtgccgtacaccgatgtgtggacgcataaaccggtgcagtactatcccgggaaacatccgtgcgaaaaaccggcagaaatgctgcagcagataatcagcgcgagcagtcgtccgggtgacctggttgcagatttcttcatggggtcaggttcgacagtcaaagcagcgatagcgctgggacgtcgtgcaactggcgttgagctggagactgagcgttttgagcagacggtcagggaagttcagaatttagtcagtcagaacggatgatattgcagaattagttacgtaccgttattatcctatgcccggccctttagctcagtggtgagagcgagcgactcataatcgccaggtcgctggttcaaatccagcaagggccaccatatcacataccgccattagctcatcgggatagagcgccagccttcgaagctggctgcgcggggttcgagtcctcgatggcggtccattatctgcattatgcgttgttggttctgatgagtgaatcattgtcttttgagcaacaggctatcatataagatagcctcagacttccttgtttattctcgccggatgcttcgtagatatttgcaggcatctgtatgcaggggtattattgcggcatatatcatccggaaaaataaaaactacatgctgatccggagatgatagttacaagtcctcccggatcccgcatatttactatattttatagataattgttcttgttaatatggagatggataaatgtattgccgtgctgtaccagttcttgttttgatattagccagtctgacaactggctgcacaaaagatgtatcgacaaataattatgatgcttctctgtatcactcagataaattaataaagtcgcaaaatttgagctcatcggaacgtacccctgatgccagtgaagaaatcaggcagtatgccattcaggtcaggaaagccatagaagaacagttaaaggatgcgagtaagtattcaggaaaagagtgttcactgagaatgtatatggccccgaatggtcttctgctacaggttaaaagagaaagcggtgatcccgatttatgtcgtgaagcgatgaatgcagtaaagaatgctgatataccatcaccaccgtcttcaggagtatataaagcatttagaaatggcgtgctggattttaaactctgacagggggagaagattttctcctgtcctgatgattttggggcgctggaaagatattgtgctgtgaagtgttaaattcctcacaattcagtaagttgacagttgcctgtcagactgagcatttgttaaaaaaatttcgcatggtgaatccccctgtgcggaggggcgactggtgaacggtatgatctctttgatgatcgtaagcgagaatatgcgggtttagtgtcaccgggctgaactcaccgggaggcacccggcaccatgcaatggcacatagcgccactctccagcccctctccggaggggctttcttgtgggcaaaaaaaaagcccgagtgggttcgggcaacagcatgagatatacatttttataatcgaatggattttaaccagaattcataaggctgcgcaactgcgcggcctttttcgtattgcgggctgtagtcttcctcctgccattgtcctgtaacttccggacttcagcccgcccctcatctgactcacaacattatcccgaccgggaggattcatgacatttaaacactacgatgtggtcagggcggcgtcgccgtcagaccttgcggagcgactgacacaaaaactgaaggaggggtggcagccatttggcagccctgtcgccatcacgccttataccctgatgcaggccattgcggcggaaggtgatgtcaccacacctgtggtggtgaagccgtcggatggagaaggcacagttatcagcaccaccagcgaaccggagtattactttgttgttgttctggcggggcagtcaaactcaatgtcttttggtgaagggctgccgctgccggagacatatgaccgtccggacccgcgtattaaacagctggcgcgtcgcagtacggtgacgccgggtggtgccgcctgtaaatataacgacatcattccggcagaccactgtctgcatgatgtgcaggatatgagtaacctgaatcatcctgaagcggaccttaataaagggcagtacggttgtgtggggcatgctctgcatgttggcaaaaagctgctgccgtttatgcctgcgaatgcgggtatccttcttgttccatgtggccgtggcgattcgggatttactgcgggggccgagggggcgtttaacgcagcgtcgggagcgaccgcaggctcgtccctgtggggggcggataaaccgctgtattatgacctggtcagcagaacccgtgcggccctgaagaaaaatccgaagaacgtgctgttatcagtgatctggatgcagggagaaaaagatgtcagttcggggagacatgcagaacacaatgcgcttttccttgccatggtaaatcagttccgtacggaactggcagatgtggcagagcagtgtactggcgggacaacggccagcgtcccgtggatttgcggtgataccacgtactactggaaggaaaggtatgcagcgccgtatgaggcggtttacggtgggtataaaggcaaagctgcgcagaatattcactttgtgccgttgatgacggatgagcatggtgtgaatgtgccgacaaacgagccgtcagaagatccggacattatcccggcgggatactatggcgctgcgtcacgcactgccagtaactggacgtcagccgatcgtaaaacgcacttcagttcatgggcgcgaagaggccttgtttcagaccgcctggcaggtgccattttgcagtacgccgggcggacattatcgttccttaccgggcagagcgcaccgcagtcgggtggtacaactcccggtgatgatgtcagtccgggggtaccgggtgttgagaaaccgcaggatggcggtgttgctggtactggtcatgatgaggccgtgagcagtaccaggacggtggctgaatatgatgcgaacagtggaaatggtgtatggacagagcagcagtggggggctgccggtggcaaaggcactgtgactgatgacggtggacggaaagcgctgcgactggaaaaacagcccggtaaactgacgtcctggaaaatgttctgtactgttgcagtggaggaggcaaaaaatcttctcagcaaggggggtgaaattgccgtacggttcaaaattccggacggaagcgaactggtgaacggacagtttgtctttggtctctactggccggtgtcgcagtgggcgtcaggcgcggcagcaaacagtatgctggcatcattcttccttcagacggatgcatcaaatctgaatcttatgcaccacaagggcacgtcgaatgcacaactgggtacatttggtgcgtttgaccataactggcatacggttgttttccgctttgcgggaaataacagcgaaagagtcgttccggtgattgatggtacagagcagacggcgtttgaccttgtgatgtggacaaatgatggctttacagcagatacgctgacgctgacagatatcacgggggcaaaagcgacgtatccggtactgcttgatacggtcacagtcaaagttaacgaaagccgggcatcatcataaccggcaaaaaaagccgccagcggcaggaacggaagctggcggaggtaatcccaatggagaatgtaaagaaaagatgctttcgtatatcggtttttaaatgaaaacagttctcattgtcaaccataacggtaagaaactatgacatttgttcatcaggtgatgctgtacttctgtacggcagtctgtgttatgtatcttctttcgggtgggtacagggcagtgcgcgatttctggcgcaggcagattgataaaagggccgcagagaaaatcagtgccagtcagtcagccggaagcaaacctgaagatccgctcattccgtagtcactttcttgacaacacctttcaacgagaaaatcctatgtcagaaataaaatcgctggtcactgctgaggcagtgaaggaagtcctgcgctctgaagaagtccggagcgcactgaaacagcaacttcggcagaaccttgaggcgcgtcttgatgcagaagtggatgccattctggatgaattgcttggtgcacagccggaaccatccccggaactgcttccggaaccacaggcggaagatgtcaccacggaaaatggtgatattcagccggagtcaccggtgacggatatgacagacacacaacccgaaccgggcacaatgctgtaacggcggggcagggccatcagtaaagagctggtggcccttttgttgttgtgagcttccgagtacgggagacggggtatgtaccagatggaaaaaatcacaacaggtgtgtcatacaccacgtcagcggtgggaacgggctactggttcctgcagttgctggacagggtttccccgtctcagtgggcggcaataggcgtgctggggagtctgctgtttggtctgctgacgtacctgacgaacctgtatttcaaaattaaagaagaccggcgtaaggcggcccggggagagtaaagcgatgaataaaaaatatgaactggttgttaaagggataaatcattacccggataagataactgttactgtggcactggaaattggtgggtatccgtcactgttgttgccatatgtggcgattagtcttgaccgtactgaaggtgccacgctggagttttacgaagctgaggcgaaaaagcaggcgaagcagtttttcatggatgttgctgccgggttatgtgaagggaacgaaccgttgccggaaaagcgccccgtaattttagaggcgcaggatgtgttgataacctacaaaggaaagctaccgggaagaattactgatgctctgaagatgccgccgtcaacactgcggtcagaaaaagatgatgttgaatcacgtattgaaaaactggagcgctatatcgctgaattgaaaaaaagcgccccaacaaaaaatgaggtgcttgcagcagatgaaatgaaagaagctattcttgatcgcgcggcgcatctaagctgcgcttcacggttgaaagagcatcttcagcggcctgaagaaaaacgccgcgatgagcagtttgctgcgtttgacgattattgtcggaaagtgatgagcagaaatctcgcagagtgtttcagtattcataatgataatttcagtgagctggaatgggagtgtaaccggccatcctttgttgtatccggtgatgccgggaaaataaccatctcagaaaatgggaaagtaacacctccatcgcaccagcacagtgaggagctcattgaatttgccattgattacctgaagaacaataaaaagcaggggctgatgaagcgcgttggccgttgcatgggatatcttcaggtagccgctgagattgaagcgctggccagtggtgctgataaggatgcaattgtgcgggaggctcttcttcgtgattttaatactccaccctttaaaaaagtgccggcttactggcttcatccggggctgacttatcttaaagtgcgtatttagtgggccagggacagcggctgaatatttaatatatccatgaacaccaaaatcaaatacggcctgtcggctgccgttctggcgctgattgccgctggtgcgcctgcgcctgacattctcgaccagtttctggatgaaaaggaaggcaaccacaccacggcataccgtgatggtgcaggtatctggaccatctgccgtggtgccatcatggtggatggcaaacctgtcgttccgggcatgaagttgtcgaaggaaaaatgcgaccaggttaacgccattgagcgtgataaagcgctggcgtgggtggagaaaaacatcagagtgccgctgaccgaaccccagaaagcggggatcgcgtcattctgtccgtacaacattggtcccggtaagtgtttcccgtcgacgttttacagacgaattaatgctggtgatcgaaaaggtgcctgcgaagcgattcgctggtggattaaggacggtggcagggactgccgtattcgctcaaataactgttacggtcaggtatcccggcgagaccaggagagcgcgctggcgtgctggggaatcgacagataagcagaatattttgctaataaatgacgttggccaaggcggacggataacacgaaatcctgcgaactggcaaaatgtaagtgaataaaagtaaaaaccccgtttgttggcagcaagcggggttttgtttttatggcagtaagctatgggaggctgccttgattgattttagcaaactgattagggagttgcgactcatgattagtcaattaccaaactggaaatttttgctggtctggagcatcccttttttatgggtagtatcccagttaattgtggcaattaaggggtagctatgtcagacaaactcataacgccggcaaaggtcctgtgtgtgattgtcggtatttcattttcactaatgctggttgctctttttctgtccctcgcctgggtgatgttgtcttcgtcggggctgctggggtgacagtgactgatgacatcagcagagcgctggcttttgctattaagtgggtggctgttggtattgctgtgtctccgatgctgtatgggctggcaaaactggtcattgcgctgaaatcgtgaactttaaaaagatgagtgctgaacttattcgggcaatggcatttgccattcgtattgtggccattgctgttctggtctgggcaattcgttggtggtgatatgaaccgtgttctgtgtgtggtgattattgtcatgctggtagcctgtggtgcgcttagtctggggctgaatcattaccgtgataacgccatcacctacaaagagcagcgcgataaaaaagtcagtgagctggagcaggcaaatgcaaccattactgatatgcagcagcgccagcgtgatgttgctgcacttgatgccagatactcgagggaattagccgatgcgagagctgaaaatgaaactctgcgcgctgacgttgccgctggtcgtaagcgcctgcgggtcaacgccacctgccccggtaccgtgcgtgaagccaccggcacctccggcgtggataatgcaaccggcccccgactggcagacaccgctgaacgggattatttcatcctcagagaacggttgatgacaatgcagaagcagctggaaggggcgcaggactatatccgcactcagtgcactaagctggctttttattatccggaggatacatgaagaaattacgggtaaccgtagaaccttttcagggaacaattccgttccgtattttgcagcgtggtcgtgttcttgttgaaggttcgttcagtggtaaatgtacgcaattacactcccggacctttcaggtgaatgccacgaatgaagagctaaccgtggagtgtacgatgaatgccgctaaatgccgcatggtatccgctgcattacagccagtgtgttgagcgaccttattatccatgcgcggtattgtcgccgtattcctgcattaacagagaccgcagcccgacagggagactcctctgcgagagtgtgcggggataatcaaaaacgatacacaccggggtttaccgcgttaacggagcgcggcgttgtcccctcatggtcgctggtccggtgcgatggtggaagaaaccggacgatgtgttacctcgcaagctctgttatgtcatgtgtctgatttgtgatttaagtcggataattgtcgttgccattaaacagaggattgatgaccgacagggtggcattgttagaataagacttattcttatctgtgccgggaatgaaaatgaaaagaaatcttccgttaattattttgttgtcttctctggttatgggctgtacgcaacataaaacagatatgccccgacagttggttaaggcattaccacaatatccggcctatgcagcggcaaattatataaagggacgggttgatgtgaagtttgatattggtgctgatggtactgtcacccgaattgagtttatccgttcagagccgcaccatttgtttgatgagcaggttgtaaaggcgatggcaaaatggcgatttgagaaggacaggccgtgtaaaggcgtgaagaaaacgtttatctttagtccttctgcacccataattatttcactttccagcacactggcggccgttactagtggatccccgggtaccgagctcgaatcgtatctattattaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggcaaaacttgggtacgagctcggatccctagtaacggccgccagtgtgctggaaaggcagctgccattgtggggtctttcttcacggccggagcatcaatggcgttatggggttcattccctggcagccggtggtttttctgccaccacgatgctgttttcactgggtgccagcatgatactgggcggtgtggcccagatgctggccccgaaggcaaaaacaccggattaccgcgcaacggataacggcagacagaacacgtatttttcctcactggacaacatgattgcccagggcaacccgatgccggtgccctacggtgaaatgctggttggttcacgacgtatctctcaggacatcagcacccgtgatgaaggcggagacggaaaggtggtggttattggtcgacagggataaaacataaaaaaatcccgcagtgatcgcggagctgcggggacagacaaatgaagattagtgttaaggagttgtttttttatgtcacggcaaaaaaacactaacgcagcgaaattatacgcgccacagtcagtgtgtgaaaatgtgaagatattcagaatttttattcagtcatgatacaggcatcctccggggtgcctgttgttttttgggcataaacagattcagacatcagacaggagagggggacagagtgggtaaaggtggcggcaaggcacacacgcctcgtgaggcgaaggataatctcaaatccacgcagatgatgagcgtgattgatgccattggtgagggaccgatagaaggtccggtgaagggactgcagagtatcctggtgaacaaaaccccgctgacggacacggacggtaatcccgtgatacacggtgtgaccgccgtctggcgtgccggggagcaggagcagacaccaccggaaggctttgagtcctccggagctgaaactgtactgggtgtggaagtgacgaaggcaaaaccggtgacacgcaccattacgtcagcgaacattgaccgcctgcgggtgaccttcggggtgcagtcactggtggagaccacgtcaaagggtgaccgtaatccgacgtctgtccgcctgctgattcagcttgagcgtggtggtaaatggatgacggaaaaggatgtcaccattaacggcaagaccacctcgcagttcctggcgtcggtgattctggataatctgccgccccggccctttaacatccggatggtcagggagacggcggacagcaccacggaccagctgcagaataagacgctctggtcgtcatacaccgaaatcatcgatgtgaaacagtgctacccgaacacggtcattgtggggctgcaggtggatgcggagcagttcggcggccagcagatgacggtgaactaccatatccgtggtcgcatcatccaggtgccgtcaaactatgacccggaaaaacgcacgtacagcggtatctgggacggcagtctgaaaccggcatacagcaacaacccggcctggtgtctgtgggacatgctgactcacccgcgctacggcatgggaaaacgcctgggggcggcggatgtggacaagtgggcgctgtatgccatcgggcagtactgcgaccagacggtcccggatggtttcgggggcacagagccgcggatgacctttaatgcgtacctggcacaacagcgtaaggcatgggacgtgctcagtgatttctgctcggcggttccggattaacgcaccggcagcgcctgccggtgttgaactgacgccggggtattttcagataacggcagtcccgcgtcttgcggtgtatgacccgacggtgcagtttgagttctggttttcggaggcaaaaattgcagacgccgcacaggtggaaacctctgtccgttatctggggaccggcagtcagtggagtgtctccggtccgcacattaagcccggaaaggatttctggttttatgtgcgcagcgtcaacctggtgggtaaatctgcttttgtggaagccagtggacgggcgagcaatgatgctgcgggctatctggaacttttccgggaaaagataggaaaactgcatctggcagaggcgctgtgggcagagattgacaacagtcagctgaaggacgagatggcggaaatgcagaccaccatcaccgaaacccgcaatgaaatcacacagacggtcagtaaaacgctggaggaccagagcgccaccatacagcagatacagcgcgtgcagaaggacacaaatgatgaccttgctgcactttacatgctgaaggtacagaaaacaaaaaatggcataccctatgttgccggtattggagcggggattgaggatactgatggccagcccctgagcaacatactgctgctggctgaccgtattgcgatgattaacccggaggacggcaacaccacgccgttatttgtggcgcaggggaatcagttgttcatgaacgatgtgttcctgaagcgactgtttgcggtgagtatcacctcgtccggcaatcccccgacgttttccctgacgccggagggcaggctgaccgcaagaaatgctgatatcagcggtaacgtgaatgcgaattccgggacgctcaacaacgtcacgattaacgagaactgtcgggttctgggaaaactgtccgcgaaccagattgaaggcgatctcgttaaaacagtgggcaaagctttcccccgggattcccgtgcaccggagcggtggccatcagggaccattaccgtcagggtttatgacgatcagccgtttgaccggcagattgttattccggcggtggcattcagtggcgctaagcataagagagagcatactgatatttactcctcatgccgtctgatagtgcggaaaaacggtgctgaaatttataaccgtaccgcgctggataatacgctgatttacagtggcgttattgatatgcctgccggtcacggtcacatgacactggagttttcggtgtcagcatggctggtaaataactggtatcccacagcaagtatcagcgatttgctggttgtggtgatgaagaaagccactgcaggcatcacgattagctgaattttataacccagatacgggcgccagaaatggcgccttttttattgcagaaaagcgagaggtaattatgcgtaaagtttgtgcagccattttgtccgcagccatctgtctgtccgtatccggtgcgcctgcatgggcgtctgagcagcaggccacgctgagtgcggggtatcttcatgccctgacgaacactaccggtagtgatgatctgaacgggattaacgtgaaataccgttatgaatttacggacacgctggggctgattacgtcattcagttatgccaatgctgaaggtgagcaaaaaacgcactacaacgatacccgctggcatgaggattctgtgcgtaaccgctggttcagcgtgatggcggggccatctgtgcgcgtgaatgaatggttcagcgcttatgcgctggccggagtgtcgtatgcccgggtgtcgtcttttgccggtgattatgtgaccctcacgtcagatgagggtaaaaagcaggagcacctgacccgttcggacagcggacgccgcagccataccgcactgacatacagtgcaggcgtgcagattaacccgacagaaaatatcgtggtcgacctggcttatgaagcctcaggacgtggtgactggcgtacggaggcgtttattgtcggcaccggataccggttctgagagtatatgacgatttatcttctgcaaacattgttataattcgcaggttcatccgcctcatgtgatgaactgcgtttgaggaaacgtaaagttacactgtcctgaagcccgtggcgtcactgctgcgggcttttttttatgggagaaatctatgacagtcagaatatcgggcgtgctgaaggacggcaccgggaagccggtgccgggatgcaccatagagctgaaagcgcgacgcaccacagagacagtgatagtcaccacggtggcgcaggggcagccgggggaaaccggcagttacagttttgatgtggagccggggtggtaccgggtgacgctgaacacggaagggtacgccccgtcgtatgtgggtgacattctggtgaaggcggattctgagccgggaacgctgaataaatttctgatggaacaggatgaggcgcagtattacccgaaagcgcttgcagagctggaagcggtggcagcggaaatcctgaagcgtgctgaagcgtcggcggcgagtgcagaggaagcgaagaaacgggcagagaatgcccggggaccggcgggcgagaagggagacacaggtccacagggtgccacaggggcacagggaccagccggggcaacgggggcggtcggaccaaaaggtgagccggggccaaagggagaacggggagaaacaggtccacagggaccgaagggcgataaaggtgacccgggcggaccgccggggccgaaaggtgacaccggcccacgtggagaggccggaccacccggaccacagggtccggcagggcaaaccggcccgaaaggggataaaggtgaacccggcgcaacaggtccggcaggtcccgcaggccctcggggagaaaccggccccgcaggtcctgcgggtcccgcaggcagtgtcgccagtgttccggatgccagcacatcacagaaaggtgttgtacagctgagcagcgataccaacagcgatgatgaaacaaaagcggcaaccccaaaggctgtgaaagcggtaatggcagaagtgcaggcggcaaaaacgaaggcagaagaggcagcaacccgggcagcagtccccggaccgaagggggacaggggggaacctggcgcacctggtgcagtggggcccgcaggcccacggggaccggctggtgcagctggtcccaaaggtgatgcaggcccggcagggccacgaggtgaaaggggacctgcgggggcacagggtgttccggggccggttggtccggcaggtcctgcgggtaaaacggggccacgaggtttgcagggagaaacaggaagacagggcccgacaggtccacagggcccgacaggtgaacccggaccacagggaccacaagggccaaccggaaggctggtacccggggaaatttacagcatcggaacatacattattgccgcactagccccgtatacaaccgacatcggcagaacctatcagccaggagaaactgtacagggttcacgccttaagcgatgcgccataatcaaagatgcaagcgggaactatatgaaagctaacaccgatggcattgacggcaacctatcctcagttccgggctcatggatggtgtgtaatgaaattacgtcgacaaatgacaatgaaggcatcgggctgttccagcgcgcatactgacagacaggagatgacatgaatgtggaaaaaaataagcaatccgcaatgggcagataaagatcacactgctgttaattgcatggtgaagtttgagcacattgagcaggcggttcctttcactgcaacagccagcgataccgaagcatacgggcgggatatttatgccgcttgtctgagaggagaggccggtgaaattgcagaatatgtacagccatccatcagcccggaaaaagccagagaactcaaaaccgccgggatcaacgcctggcgtaatgcgatggaagcggcgaactacacgtttgagcacaatgggcgtaaatgggactacgggaagtcaacgcagacgcgtcttgagccgtcggtggcggcagcgaaagcggggaaactgccggaggcgtttttctggacggatgcggacaataatgacgtaccgatggacgctgaaacactgattgctctgagtgctgctgcagagcaggcgatgtttaccaaagggatggaaattcatgtcagacagcgcacgatgaaaaaagagattgaagcgctggatgatgcggaagctatactggcgtataaaatcggtatcacagacggctgataaaaaagagaggggcaagccatagccccttgctacaaatctacagctaaataataccctggttgaggcaaattattcggtaataaaaattggtaatgactccaacttactgatagtgttttatgttcagataacacacacacaatttgatcaatacgttcaatctgtccatgtgtttcctcgaggtgcgcatgaaaagcctgacttaatttttcgtttgatgttgctcttgcgagttttgccagtgcccgggttaattgtttttctgcgctgtaggtatctgaaagcaggtgaatagtttcattaatatgagtgttgtgtgtcgacactcattaaaattagtcgttaatgagaattagtcaaattaagcgtaacgagaagaaagtggaaaaatatattttgaggaacgttctggatgtattaacaattgcctgaggaataagtgacttagagaaaattattgattttactggtgttatgttgcgggattaatttttttgattatattactgttgggcggaaaaaagacgtaagttgacgttcgacaggggtaagcgaaacggtaaaaagataaataacaaatgaatttaggatttttccggcttcgttaaagaaagttaaaatgccgccagcggaactggcggctgtggaattaactgcgcgtcgccgctttcatcggttgtacaaaagctttcagtgccgccagcattttctctggctcattaatatgttgctcgatgattttaacgatggccgaaccagaaatcgcgcccgcagctcctgcatcaatcgctgcttttacctgatccggggcggaaataccaaatccctgcaatggaggcgcagcgttgtactctttcagcttcgcaaccagatgattgaggggtaacgcggcgcggttttctgcgccggtcacgcccgctcgcgacagcaaataggtgtaaccacgaccgtaagaggctatctggcgcagcaaatcatcgtcggcattaggcgggcaaataaagataggtgcgacattatgacgcaacgcggcctggcggaagggcgcggactcttccacgggcacatcggcaaccagcaccgaatcgacgccgactttctcgcactcggcataaaactcatcaatgcctttgttaaacaccaggttggcatacatcaaaaggccgatgggaatggtcgggtgcttctggcgaatgagtgccagcacctcaaagcactgcgccggggttactcccgccgcaaaagcacgcagtgtggcgttttgaatcgtcgggccatccgccagtgggtcggagaaggggatgcctaactccagcgcgtcagcaccggcttcaattagcgtatcgataattttcaacgactgctcaatgcccggatcaccgagggtgacgaaaggaatgaatgcgccttctttgcgctccttcaactgggtaaacagagattcgtagcgttccatcagatttcccctcgtgctttcaaaatatcgtgaacggtgaagatgtctttatcgccgcgaccggaaaggttaaccaccagtagctgctctttttccggattttcgcgcatcattttcagcgcatgggccagggcgtgggaggattccagcgccgggatgatcccttcatgcaggcaaagcgttttaaaggcttccagggcttcatcgtcggtaatagacacgtaatcagcgcgtccagtgctgttgagatacgcatgttgcgggccgacggacgggaaatccagcccggcagaaatggagtaagactcttcaatttgcccgtcttcggtttgcatcatcggcgctttcataccgaaatagatgcccacgcgaccatgttttaacggtgcgccgtgctcgccagtttcgataccgtggccgccaggctccacaccaatcaggccgacgtcggtttcgttgatgaaatctgcaaacataccgatggcattcgaaccaccgccaacacaggcgataacggcatccggcaggcgaccttctctttccagaatctgcgctttcgtttcttcgccaatcatccgctgaaactcacgcacaatggtcgggtaaggatgcgggccagctgcggtacccagcatatagtgcgcggtttcataactgccggaccagtcgcgtagcgcctcattacaggcatctttcagggtcgcggaaccgctatgtaccgggatcacttccgcacccattaagcgcatccggaaaacgttaggcgactggcgttcaacgtctttggcacccatataaatacggcatttcaggccgagcagggcgctggcaagggccgacgccacgccatgctgaccggcaccggtttcggcaataatttcagttttacccatccgcttcgccagtaaagcctgaccgagtacctggttagttttatgcgcgccgccgtgcagcaaatcttcgcgcttcagatacagcgtggtgttcgtcccggctgtaatgttctggcatttggtcagcgcggttggacgcccggcatagtttttcagcaggtcgttgaactgagcctgaaattcaggatctttttgcgcgctgacaaaagcttcttccagctggcgcagagcaggcatcaggatttgtggcacgtacatgccgccaaactcaccaaaataggggttaagtaatgttgtcattgttcctttccttaatatgcgcgcagcgtctggaaaaccgaggccaaaagacgtgcgtctttgatacccggttgcgactctacagcagaattaaaatcaagcccggcgcagccggtttgtgccgcttccacgcagttatctgcgcctaagccccccgccagcagaacgttgccaagcgattgaccatttaatagtgaccagtcgaaacgttgtccgctcccgccctgaccgttgtcgaatacatatttatcgatgtgctgaaaatcgcgcgcgggaagagtttcaccgacacttaaagccttccagatggcgacgtgtgctggcagagcctcacgcagagtgtcgatatacagctgatcttcattaccatgcagttgcactgccgccagcgataacaccttagctttgtccaccacatcggcaatatcgtgattgcggaacacgccaacatactgcaacggtgccgcagccatcacttcctgcgcctgttcaacgttgacgcaacgcggtgatgtcgcaacaaaaatcagcccaccgtaaatcgcgcccgcgtcataagctgctttagcatcttgttcacgcgtcaggccacatactttattctcacccagcaacacccgacgcacggcggcgttcaaatcgtcatgggccatcaacgccgaaccaatcagaaagccgttagtgaagtggcttaactcgcgcacctgagcgtaagtattgatgccggattcgctgattaccgtcacgttgtgccccagtttcggcgcaagctcgcgggtacggttgagatcaatcgacaaatcgcgcagatcgcggttgttgatgccaacgacctttgctcccaatgcaatggcgcgctccagttcctcttcattactgacttcggtcagcacacccatctccagactgtgagcgacggtggcaagctggcgatattgttcgtcatccagtactgaaagcattaataagcaggcatcggcctggtaatagcgcgccagatagatctggtaaggatcgataatgaagtctttacataaaatcggctgcggggcgatttggctgacgatggggaggaaatcaaagctcccctgaaaatatttctcatcagtcagcactgaaattgccgaagcgtaatgtttataaatggcggcaatgcgtgccggatcgaaatcatcacggatcacgccttttgacggcgaggctttcttgcactcaagaataaacgccgtgcgtgcaccctgtagcgcatcataaaaatgtcgcgtgctcggctgaatctcattctgaaaactggccagcggttgctgctgtttgcgggtttctacccaaatcgccttgtctgcgacgattttcgctaaaacggtttgcatcatttaccctcgtgccgccagtgcggtgactctgtcgtaagcggaaccactgcgcagtacctcaagaacggtttgcgcattggcttgcagatcttcatggccatgcaggcgcattaacatggcgacattcgccgcgacggctgcttcgtgagcggcatcgcctttaccttgtaacaaacgtgttaaaatgtcacggttttcttccggtgttccgcctgccagttgctcctggtggtagggtgtcaggccaaagtcttctgcggtgagctgatagcttttaatttcgccgtcatgcagttcggcaacgattgtcggcgcgtgtaatgaaacttcatccatcccgccgctgtgcaccaccgccgcgcgttgataccccagcacgcgcaaagtttcggcaatcggcagcaccagttccggactataaacaccaattagcgccagcggaggatgcgccgggttaatcaatggccccagcacattgaacagtgtgcgggtttttagttgctggcgaaccggcattgcatggctgaatccggtgtgatatttcggtgcaaagaggaaacagacgcctaactcatccagcgcctggcgcgatttatcggcgttcatatcaagattaataccgaacgccgccagcagatccgacgagccggatttactggagacgctacggttgccgtgtttcgccactttgagcccgcaggccgcggcgacaaacgcactggcggtagaaatattgatgctgttgctgccgtcaccgccagtaccgacgatatcggcaaacagataatccgggcgcgggaacggcgcggcgttttccagtagcgcggttgccgccccggcgatctcattcgggtgctcaccgcgaattttcatgctcaccagcgccgccgccagttgttccggcttcagctcgccacgtaccaccgctgaaaacagctggtggctttcttgttggctaagcgtctgggcctgatacagtttttccagaatcggttgcagcgtgttggttggctttagtttctgctgcgcccaggccagcgtttgttccagcaggcgagcgccctgggtagtaagaatggattccggatggaactggaatccacaaacgtgatccgcatcatgacgcaccgccatcaccatgccattaaaatgggcgttgatggttaaaccggccggaatattactgccaaccagcgagtgataacgcgccactggcagcgggtttgttaatccggcaaacatcgcctgaccgtcatgttcaatgctcgacgctttaccgtgaagaatttcgcccgcctgaccgacatagcccccgtaagcttcgacaatcgcctgatgtccgaggcaaatgccaataattggcagcttgccacgcaagcgggtgaggagttccggcatacaaccggcttcgctcggcacaccggggccaggagaaagcatcagcaccggattgctcatcgtcgccaggcgttcaattaaggtctgcgccggaatatggttgcggtaaatcaccacgttatgaccattgctgcgcaactgatctgccaggttgtacgtaaaagagtcgatattatcgagcagcagaatgtcagccattagaacgtctcctgtgcatgatgcgcggtggcaatagcgcgcagtacagcgcgggctttattacgagtttcgtcggcttccgactgcggaacagaatcaaggactacgccagcaccggcttgcacggtggcgataccgttttccaccagcgccgagcggatcacaatgcaggtgtcgagatcgccatgcgcggtaaaataacctaccgcgccgccgtagctgccgcgtcgacgaccttctgcttcggcaattaactgcatagcgcgtactttcggtgcaccgcttaacgtccccatattcatacaggcgcggtaagcgtgcagggcgtcgagatcgtggcgcagctcaccaacaacgcgggagaccaggtgcatcacgtaagagtaacggtcaactttggtgagatcggcgacgtagcggctgccgggtgtgcaaatgcgagccaggtcattacgggcgagatccaccagcatcagatgttcagaaagctctttatgatcggtgcgcatttccagttcgatgcggctgtcgaggtctctatccagtgaaccatcggcacgacgaccgcgtggacgtgttccggcaatcgggtaaatctcaatctggcggctggtggcgtcatacttgagcgaactttccggcgatgcgccaaacagggtgaaatcattatcctgcataaaaaacatgtacgggctgggattactctttttcagcacgtaataggccgccagcggtgacgggcagggcagagagaaacggcgagatggcaccacctggaaaatttctccggcgcgaatcgctttttgcaacaaacgcactacgccaccgaactcttcatcgctctggttacattcacaacgcatatgcggcacggaaaccaccggcagaggcggcgcggcttcggtcagttgctgacgtagttcgttaaggcgagcagtgagacgttgtttttcttcttcattcggagcaaacaggctggcctgaatacgggtgctttttttctgatggtcaatcaccatcagcgtttcagcgagataaaaacagaaatcagggcagttattttccgctgacagttgcggtaaatcttcaaatcccgccacaaggtcataagagaacaggccgccgaagaacattgcttctcgttcttccttcggtacattcaacagattctgtaataagcggaaagcgtcaaaaatcgaaagggagcataagcgggcgtcttcatccagcagtggactgacaggcgggaagcgcagtacgcggcagtttggtgattgttcattttccacacccgcaggcagggcgttatccagtagtgccagcagggcttcgccattgccggaaagtgcctggattgtgacggtgtcacctaatgctgtaatgcgcagcgcactgtctaccagcagcaggctttttaaatcatctttgctgtcgatatctgcggattccagcagcagcgttgccggacgatccccacacaactggtgaaaaagcgcggttgggttgtcgcgataagcgcctacgcaggttagcagttcgagagtcggtttttgtgtttgcattgttattctctaattttgttcaaaaaaaagcccgctcattaggcgggctgggtatctgattgctttacgcatggtgaatacactgcccgtttcaggaagtgcgccaccaacctttcagtacgaaaattgctttcattgtcgataccctttttacgtgaacttgcgtactagttaactggttcgatgattaattgtcaacagctcatttcagaatatttgccagaaccgttatgatgtcggcgcaaaaaacattatccagaacgggagtgcgccttgagcgacacgaattacgcagtgatttacgacctgcacagccataccacagcttccgatggctgcctgacgccagaagcattggtgcaccgtgcagtcgagatgcgcgtcggcaccctggcgatcaccgaccatgacaccacagctgcaatctcaccagcaagagaggaaatttcacgttcgggactggcgctgaatcttattcccggcgtggaaatctccacggtctgggaaaatcatgaaattcatattgtcgggctgaatattgatattactcatccgctaatgtgtgagttcctcgcgcagcagacagaacggcgcaatcagcgggcgcagctcattgccgaaagacttgaaaaagcgcaaatacctggggcgctggaaggtgcgcaacgactggcgcagggcggcgcagtgacgcgcggtcattttgcgcgtttccttgttgagtgcggcaaagccagttcaatggcggatgtctttaaaaagtatctggcgcgcgggaaaaccggatacgttccgccacagtggtgtacaatagaacaagctattgatgtcattcatcattctggcggtaaggcggtgctagctcatcctgggcggtacaatcttagtgctaaatggctgaaaagattggttgcgcattttgccgaacaccacggcgacgcgatggaagtcgcgcagtgccagcaatcgcccaatgaacgcacccagctggcgacacttgcgcgtcagcatcatttatgggcatcacaaggatctgattttcatcagccatgcccgtggatcgaactgggtcgtaaactctggctgcccgcaggcgttgaaggcgtctggcagctatgggaacagccgcagaacaccacagagagggaattatgagccagtttttttatattcatcctgataacccgcagcaacgtctgatcaaccaggcggtggagatcgtgcgtaaaggcggggtgattgtttatccaactgattccggctatgcgctcggctgtaaaattgaagataaaaacgcgatggagcgtatttgtcgtattcgccagctgccggacggtcacaactttaccctgatgtgtcgcgatctttctgaactctcgacctattcatttgtcgataacgttgcgtttcgtttgatgaaaaacaacacgccgggcaactataccttcatcctgaaggggacgaaggaagtgccacgccgtctgttgcaggaaaaacgcaaaaccatcggtatgcgtgtgccttctaacccgattgcgcaggcgctgcttgaagcattgggcgaaccgatgctttccacttcgctaatgctgccaggcagcgaatttaccgaatccgatccggaagaaattaaagaccgtctggaaaaacaggtggacttgattattcacggcggttatctcgggcagaaaccaacaacggttattgatcttaccgatgatacgccggtcgtggtgcgtgaaggcgtaggtgatgtgaagcctttcttataacaaattgcgttccacggatggaaaatgatggcagggatatatcgctgcattttgctgttgatagttgggctttttttctcttcgttgagttatgcgaaaaacacggagatcccttcttatgaagaagggatctcgctctttgatgttgaagccactctgcaaccgaatggggtgctcgacatcaaagagaacattcattttcaggcgcgaaatcagcagattaagcacggattttatcgtgatttaccgcgactctggatgcagcctgatggggacgctgcactgctgaactatcatattgttggcgtcacccgtgatggtattcctgaaccctggcatcttgactggcatatcgggttaatgagtattgtcgtgggcgataaacaacgtttcttgcctcaaggcgactatcattatcaaattcattatcaggttaaaaatgctttcctgcgtgagggggattctgatctgctaatctggaacgtgaccggtaaccactggccgtttgaaatttataagaccctattttcactcaagttgcctgatattgcgggtaatccatttagcgaaatcgatctctttactggagaagagggcgacacatatcgaaatggccgcatccttgaggacggaagaattgaatctcgcgatccgttttatcgtgaagatttcacggtcctctaccgctggcctcacgcattacttggtaatgccccggctccacaaacgacgaatattttcagtcatcttcttttaccctctatgtcatcgttgttaatttgctttccgagtctgttcctggcgtgtggatggttatatctctggaagcgcaggccgcaatttacgccggtagatgtgattgaaaccgatgtcattccgccagattacacgcccggcatgttacgtcttgatgcgaaactggtttacgacgataaaggtttttgcgccgatatcgtaaatctgattgtgaaaggaaaaattcatctggaagatcattatgacaagaaccagcaaatcctgattcgtgttaatgaaggcgcgaccagaaataatgcggtattactgcccgcagagcagttattactggaagcgttatttcgtaaaggcgataaggtcgtgcttacggggagacgcaacagagtcttacgcaaggcatttttacggatgcagaaattttatctgccgcgtaaaaagtcttcgttttaccgacctgatgcgtttttgcaatggggcggaatggcaatattggcggtcattctctacggtaacctgagtcccgtaggctgggcaggaatgagtctggtaggcgatatgtttattatgatctgctggcttcttactttcttattttgttcccttgatcttttgtttgcccgcgatgatgacaagccttgcgttaatcgtgtcatcatcactttgtttttaccactgatttgttcaggtgtggctttttactctctctacatcaatgtcggagatgtattcttttactggtatatgccagcgggttattttagcgcggttttcctgaccggttatctcactggcatggggtatatttttctgccaaagtttacccaaactgggcagcaacgttatgcccacggtgaagctatcgttaactatcttgcgcgtaaagaggcagcaacacacagtgggcggcggaggaaaggggaaacacggaaactggattacgcgttgttaggttgggctatatcggcaaatttggggagggaatgggcgttacgcatcgccccttcgctttcttcggcgatttgcgctccagagattgcccgtaacggcgttttattctcattacagacgcacctgagttgcggggtctataccagtttgttggggcggagctattctggtggtggttctggcgctggtggcggaggcggtggtggctggtaatcaagctgatgttaatcgaaacaagctttaaccataaagatagtgtagtatgttgcgcctcaaagccaggcaagttaaaacgtcgagtcgtttacttaaggcctgaagagttcaaacagactttactatcagtgagtcagatgtaagttctgactcattgttgcacaaaagcatatcagacgcctgggaaggcgacaccaaaaggaagctctatgagcgaaaagctacagaaagtgctggcgcgtgccggccacggttctcgccgtgaaatcgaatctattattgaagccggtcgtgtgagtgttgatggcaaaattgctaaactcggcgatcgcgttgaaattacccctagactgaaaatccgtatcgatggtcatctgatttcggtacgtgagtccgctgaacaaatttgtcgcgttctggcctattacaaaccggaaggtgagttgtgtacccgtaacgatccggaagggcgtccaacggtgtttgaccgtctgccaaaactgcgtggcgcacgctggattgccgtaggtcgtctggacgttaacacctgtggtctgttgctgttcaccaccgacggtgaactggcaaaccgtttaatgcatccaagccgtgaagttgaacgtgaatatgccgtgcgtgtatttggtcaggttgacgacgcgaaactgcgtgatttgagtcgtggcgtgcagctggaagatggtccggcagcctttaaaaccatcaagttcagcggcggcgaagggatcaaccagtggtacaatgttactctgaccgaaggccgtaaccgtgaagttcgtcgtctttgggaagcggttggtgtgcaggtgagccgcctgattcgtgttcgttacggtgatatcccactgccaaaaggtctgccacgcggtggctggacggagctggacctcgcccagactaactatctgcgcgaactggtggaactaccgccagaaaccagctctaaagtcgctgtagaaaaagaccgtcgtcgtatgaaggcgaatcaaattcgtcgtgcggtgaaacgtcacagccaggtgagcggcggtcgtcgttctggtggacgtaataataacggttaatcaaagtatgccggacgtcatatccggcatttttacagattagtaatcaatccctatctgcgcttttacacctgcatcaaacgcatgtttgatggggcgcagctcacttaccgtatccgccagttcaagaatatcccgatgacaaccacgacctgtgataatcaccgtctgttgatgtggacgttcatttaacgcctgaatcacgtcttccagtggcaaataatcatacgctaccatatatgtcagttcatcgagcaaaaccatatccagtgaggaatcagccagcatccgctttgcatgttgccagacttcgcggcaggcggcggtatcagactctcggttttgtgtatcccaggtaaagcccgttgccattacctgaaactcaacgccgtgtggctccagcagatttcgttcaccattaggccaggtgcctttaataaactgcacgacgcccactttttttccgtgaccaactgcgcgtgttgccgtaccaaatgccgcggtggttttgccttttccattgccggtaaagacgatgataataccgcgttcatcctgggcctgggccacacgagcatctactttttctttcactcgctgctgacgctgttggtagcgttcatcactcattgggaaattcctggtttacggcccggttgggcgtcaaaggtcatgccggttttacggcggctgtcatcgcccatcagccagaggtagagcggcatgatatcagcgggggttttaagtttctgtggatcttcggtcgggaaggcgctggcccgcattgcggtgcgcgtaccgcctgggttaatgcagttgacgcgcaggcgctgctgatattcatcggccagtacctgcatcatcccttcggtggcaaatttcgacgctgcatatgcgccccagtttgcacgcccctgacgtccaacgcttgatgaggtaaagaccagtgaaccggcatccgatttgagtaataaaggaagcagtgcctgtgtgagcataaaggtggcattaacgttgacctgcatgacgtcctgccagacctgcggatcttgttcgctcattgggcaaacatcgccgagcaatccggcattatgcaaaacaccatccagacgcggataattaacggcaatgcgctgtgccagttgttggcaatcttcggacgtgcaggttagcaaatcgagaataaaccactgtggctgacgtccaatttcttcgtttatgtggctggctacctgacgtaatttttcttcattacggcccaaaagaatcactgtcgcaccatagcgtgcatacgtcatcgctgcttcacgaccaattccatcgctggctcccgtcaccaggataatgcgatcattgagtaaatcttgttttggctggtaatgcatggctactcctcaacgacgttgtctgtcgcgctgccagtgtactttatgactttggggctttatgcctgaaacagaagggcatttcaatcagcctggggcgataacaccgcaaaatggatactttgtcatactttcgctgcaataacatctctgcgagacggctaaacatgcctgttgtaaactgtgagccaaagcgttgtttaaccaaggtggggactcgtggaattgttgtctgaatatggtttgtttttggcgaaaatcgttaccgttgtgctagcgattgcggcgattgccgccattattgtcaatgttgctcaacgtaataaacgccagcgtggcgagttacgagtcaacaatctcagcgaacagtataaggagatgaaagaagaactggccgcggcgctgatggacactcatcagcaaaaacagtggcacaaagcgcagaagaaaaagcacaagcaagaagcgaaagccgcaaaagcgaaagctaaactgggcgaggtggtaactgacagtaaaccccgcgtctgggtgctggattttaaaggcagcatggacgcccatgaagtgaactcgctacgtgaagagataacggcggtactcgcagcattcaaaccgcaggatcaggttgtgctccgtctggaaagcccaggtggcatggtgcatggttacgggttggcggcttcgcagttgcagcgtctgcgtgataaaaacattcctttaactgttacggtagacaaagtcgctgccagcggcggttacatgatggcctgtgtggcggacaaaattgtttccgcaccgtttgctattgtgggttccattggggtggtggcgcaaatgcccaactttaaccgcttcctgaaaagcaaagatattgatatcgaactgcacaccgccgggcagtataagcgcacgctgacgttgctgggtgaaaataccgaagaagggcgggagaaattccgcgaagagttgaacgaaacgcatcagttatttaaagattttgtgaagcgtatgcgtccgtctctggatattgaacaggtggcaacgggtgaacactggtacggacaacaggcagtagagaaaggcctggttgatgaaatcaacaccagtgatgaagttattcttagcctgatggaaggccgggaagtggtcaatgtacgctatatgcagcgtaaacgactcattgaccgattcaccggcagcgcggcagagagcgccgatcgattgttgttacgctggtggcagcgtgggcaaaagtcgttgatgtaaaagacaaacgcgaggataagacctcgcgttttgctttaatcaaccaggtgatatttttctgaaagcacatgggccaggtgtttgaacatattaaacaccgcggtgcttttggcagttggtaatccttgttcatctaaaaagtagtcgccggtaaataccagcacgccattacgctgcgtgacgccggtggcttcaatccctgcgagcgtatcctcatgctcacgaatgattttgttggcctctttcaacagcgtttcgcggtcgatgggttgagtctctttgttcattatttactccttaaacaaggacattagtctacgccaggcatggcttgcagacaaatataccacgctggcggcaagagcgccttactggcaactttggattttgcatgctaataaagttgcgcatcggattttatcaggtacagtgtgacgctttcgtcaatctggcaatagattttcttgacattcgaccaaaattccgtcgtgctatagcgcctgtaggccaagacctgttaactcagtcacctgaattttcgtgaacagagtcacgacaaggggttgatatccgcagagagcgagtccatatcggtaactcgttgccagtggaaggtttatcaacgtgcgacgcattcctggaagaatcaaattaggtaaggtgaatatgggtaaagctcttgtcatcgttgagtccccggcaaaagccaaaacgatcaacaagtatctgggtagtgactacgtggtgaaatccagcgtcggtcacatccgcgatttgccgaccagtggctcagctgccaaaaagagtgccgactctacctccaccaagacggctaaaaagcctaaaaaggatgaacgtggcgctctcgtcaaccgtatgggggttgacccgtggcacaattgggaggcgcactatgaagtgttgcctggtaaagagaaggtcgtctctgaactgaaacaactggctgaaaaagccgaccacatctatctcgcaaccgaccttgaccgcgaaggggaagccattgcatggcacctgcgggaagtgattggtggtgatgatgcgcgctatagacgagtggtgtttaacgaaattactaaaaacgcgatccgccaggcatttaacaaaccgggtgaactgaatattgatcgtgttaatgcccagcaggcgcgtcgctttatggaccgcgtggtggggtatatggtttcgccgcttctatggaaaaagatcgctcgtggtctgtctgccggtcgtgtgcagtcggtggcggtccgcctggtggtcgagcgtgagcgtgaaattaaagcgttcgtaccggaagagttctgggaagtcgatgccagcacgaccacgccatctggtgaagcgttggcgttgcaggtgactcatcagaacgacaaaccgttccgtccggtcaacaaagaacaaactcaggctgcggtaagtctgctggaaaaagcgcgctacagcgtgctggaacgtgaagacaaaccgacaaccagtaaacctggcgctccttttattacctctacgctgcaacaagctgccagcacccgtcttggttttggcgtgaaaaaaaccatgatgatggcgcagcgtttgtatgaagcaggctatatcacttacatgcgtaccgactctaccaacctgagtcaggacgcggtaaatatggttcgcggttatatcagcgataattttggtaagaaatatctgccggaaagtccgaatcagtacgccagcaaagaaaactcacaggaagcgcacgaagcgattcgtccttctgacgtcaatgtgatggcggaatcgttgaaggatatggaagcagatgcgcagaaactgtaccagttaatctggcgtcagttcgtagcctgccagatgaccccagcgaaatatgactccacgacgctgaccgttggtgcgggcgatttccgcctgaaagcacgcggtcgtattttgcgctttgatggctggacgaaagtgatgcctgcactgcgtaaaggcgatgaagatcgtatcttaccggcagtcgataaaggcgatgctctgacgctcgttgaactgacaccagcccagcactttaccaagcctccagcccgtttcagtgaagcatcgctggtcaaagagctggaaaaacgcggtatcggtcgtccttctacctatgcgtcgatcatttcgactattcaggatcgtggctatgtgcgagtagaaaatcgtcgtttctatgcggaaaaaatgggcgaaatcgtcaccgatcgcctggaagagaatttccgcgagttaatgaactacgatttcaccgcgcagatggaaaacagcctcgaccaggtggcaaatcacgaagcagagtggaaagctgtactggatcacttcttctcggatttcacccagcagttagataaagctgaaaaagatccggaagaggggggtatgcgcccgaaccagatggttctgaccagcattgactgtccgacttgtggtcgcaaaatggggattcgcacagcgagcaccggggtattccttggctgttctggctatgcgctgccgccgaaagagcgttgcaaaaccaccattaacctggtgccggaaaacgaagtgctgaacgtgctggaaggtgaagacgctgaaaccaatgcgttgcgcgcaaaacgtcgttgcccgaaatgcggcacggcgatggacagctatctcatcgatccgaaacgtaagttgcatgtctgtggtaataacccaacctgcgacggttacgagatcgaagagggtgaattccgcattaaaggttatgacggcccgatcgttgagtgtgaaaaatgtggctctgaaatgcacctgaaaatggggcgtttcggtaaatacatggcctgcaccaacgaagagtgtaaaaacacacgtaagattttacgtaacggcgaagtggcaccaccgaaagaagatccggtgccattaccggagctgccgtgcgaaaaatcagatgcctatttcgtgttgcgtgacggtgctgccggtgtgttcctggcggccaataccttcccgaaatcgcgtgaaacgcgtgcgccgctggtggaggagctttatcgcttccgcgaccgtctgccggaaaaactgcgttatctggccgatgcgccacagcaggatccggaaggtaataagaccatggttcgctttagccgtaaaaccaaacagcaatatgtctcttcggaaaaagacggaaaggcgactggctggtcagcattttatgttgatggcaaatgggttgaagggaaaaaataacctttaattctgtcgggtttttataaacaaagggccgcgaaagcggcccttttttattgcatattattttttcttcacacctatacactaaggctataaatgatatagtggttatagttagcaccttttttattattaaatcgtattagtcacccgcctggtgtgacgaaaaaacgatgttctgatggcgtctaagtggatggtttaacatgaaattacaacaacttcgctatattgttgaggtggtcaatcataacctgaatgtctcatcaacggcggaaggactttacacatcacaacccgggatcagtaaacaagtcagaatgctggaagacgagctaggcattcaaattttttcccgaagcggcaagcacctgacgcaggtaacgccagcaggacaagaaataattcgtatcgctcgtgaagttctgtcgaaagtcgatgccataaaatcggtcgccggagagcacacctggccggataaaggctcgctgtatatcgccaccacgcatactcaggcacgctatgcgttaccaaacgttatcaaaggctttattgagcgttatcctcgcgtttctttgcatatgcaccagggctcgccgacacaaattgctgatgccgtctctaaaggcaatgccgatttcgctatcgccacggaagcgctgcatctgtatgaagatttagtgatgctaccgtgctaccactggaatcgggctatagtagtcactccggatcacccgctggcaggtaaaaaagccattaccattgaagaactggcgcaatatccgttggtgacatataccttcggctttaccggacgttcagaactggatactgcctttaaccgcgcagggttaacgccgcgtatcgtcttcacggcaacggatgctgacgtcattaaaacttacgtccggttagggctgggggtaggggtcattgccagcatggcggtggatccggtcgccgatcccgaccttgtgcgtgttgatgctcacgacatcttcagccacagtacaaccaaaattggttttcgccgtagtacttttttgcgtagttatatgtatgatttcattcagcgttttgcaccgcatttaacgcgtgatgtcgttgatgcggctgtcgcattgcgctctaatgaagaaattgaggtcatgtttaaagatataaaactgccggaaaaataatttcttgcgttattttcggcaccttttatgtagcgaaggtgccggaatatattctcctttgttacttatttgtatccggtgcacaatatttttatccctcatatttatagggtaaattacctgtaaagtagtgtctaattacacacctcgcaaactccagtttttaaatatctatttcaggtcaaaagattgaattattcactggagacgattcgtaaattcgctggatttttgactaaagtttctttaggatttgtctcatcgtatgattaattacaccaatcgttcaacgtcttgctgataagtgatggcgattatatgaggttagcaatgccttctggaaatcaggaaccccgccgcaatcctgaattaaaacgtaaagcctggctggcggtttttcttggttctgcacttttctgggtggttgtcgcactgtttatttggaaattgtggggataactatggtcggtcaggagcaactggagtcgtcaccattatgtcagcatagtgacaatgaaccagaagcaaaacgggaatgttccgtcgttattccagacgactggcaactaacatcgcagcaacaagcctttatagaactgtttgctgaagatgatcagccgaaacaataattatcatcattcttattacccatttttaatgaattacagggcttttaatacaccgcagcaataacaggttgagttatctcaacacaaagtaataaccgttaagggtgtagcctatgatcaacacaaatatgaaatattggtcctggatgggcgcattttctctgtcgatgctcttctgggctgaactcctctggatcattactcactgatccctgaccccgctgtttgctttgcctcaaggtttctcctcttttatcaatttgggttgttatcaaatcgttacgcgatgtttgtgttatctttaatattcaccctgaagagaatcagggcttcgcaaccctgtcattaaggaggagctatgtcgtcaaccctacgagaagccagtaaggacacgttgcaggccaaagataaaacttaccactactacagcttgccgcttgctgccaaatcactgggcgatatcacccgtctacccaagtcactcaaagttttgctcgaaaacctgctgcgttggcaggatggtaaatcggttaccgaagaggatatccacgcgctggcgggatggctgaaaaatgcccatgctgaccgtgaaattgcctaccgcccggcaagagtgctgatgcaggactttaccggcgtacctgccgttgttgatctggcggcaatgcgcgaagcggttaaacgcctcggcggcgatactgcaaaggttaacccactctcaccggtcgacctggtcattgaccactcggtgaccgtcgatcgttttggtgatgatgaggcatttgaagaaaacgtacgcctggaaatggagcgcaaccacgaacgttatgtgttcctgaaatggggaaagcaggcgttcagtcggtttagcgtcgtgccgccaggcacaggcatttgccatcaggttaacctcgaatatctcggcaaagcagtgtggagcgaattgcaggacggtgaatggattgcttatccggatacactcgttggtactgactcgcacaccaccatgatcaacggccttggcgtgctggggtggggcgttggtggcatcgaagcagaagccgcaatgttaggccagccggtttccatgcttatcccggacgtagtgggctttaaacttaccggaaaattacgcgaaggtattaccgccacagacctggttctcactgttacccaaatgttgcgcaaacatggcgtggtggggaaattcgtcgaattttatggtgatgggctggattcactaccgctggcggatcgcgccactattgccaatatgtcaccagaatatggtgccacctgtggcttcttcccaatcgatgctgtcaccctcgattacatgcgtttaagcgggcgcagtgaagatcaggtcgagttggtcgaaaaatatgccaaagcgcagggcatgtggcgtaatccgggcgatgaaccaatttttaccagtgtgttagaactggatatgaatgacgttgaagcgagcctagcagggccaaaacgcccgcaggatcgcgttgcattgcccgatgtaccaaaagcatttgctgccagtgcgaactggaagtgaatgccacgcataaagatcgcctgccggtcgattatgttatgaacggacatcagtatcagttacctgatggcgctgtggtcattgctgcgataacatcgtgcaccaacacctctaacccaagtgtgttgatggccgcaggcttgctggcgaaaaaagccgtaactctgggcctcaagcggcaaccgtgggtcaaagcgtcgctggcaccgggttcgaaagtcgtttctgattatctggcaaaagcgaaactgacaccgtatctcgatgaactgggatttaaccttgtgggatacggttgtaccacctgtattggtaactctggaccgttgcccgatcctatcgaaacggcaatcaaaaaaggcgatttaaccgtcggtgcagtgctgtccggcaaccgtaactttgaaggccgtatccatccgctggttaaaaccaactggctggcctcgccgccgctggtggttgcctatgcgctggcgggaaatatgaatatcaacctggcttctgagcctatcggccatgatcgcaaaggcgagccggtatttctgaaagatatctggccatcggcacaagaaattgcccgtgcggtagaccaagtctccacagaaatgttccgcaaagagtacgcagaagtttttgaaggcacagccgagtggaaggaaattaacgtcacacgatccgatacctacggttggcaggaggattcaacctatattcgcttatcgcctttctttgatgaaatgcaggcaacaccagcacctgtgaaagatattcacggtgcgcggatcctcgcaatgctgggggattcagtcaccactgaccatatctctccggcgggcagtattaagcccgacagcccggcgggtcgatatctacaaggtcggggtgttgagcggaaagactttaactcctatggttcgcggcgtggtaaccatgaagtgatgatgcgcggcaccttcgccaatattcgcatccgtaatgaaatggtgcctggcgttgaaggggggatgacgcgccatttacctgacagcgatgtcgtctctatttatgatgccgcaatgcgctataagcaggagcaaacgccgctggcggtgattgccgggaaagagtatggatcaggctccagccgtgactgggcggcaaaaggtccgcgtctgcttggtattcgtgttgtgattgccgaatcgtttgaacgaattcaccgttcgaatttaattggcatgggcatcctgccgctggaatttccacaaggtgtgacgcgtaaaacgttagagcttaccggggaagagaagattgatattggtgatctgcaaaatctacaacccggcgcgacggttccggtgacgcttacgcgcgcggatggtagccaggaagtcgtaccctgccgttgtcgtatcgacaccgcgacggagttgacctactaccagaacgacggcattttgcattatgtcattcgtaatatgttgaagtaacgagtatttgcttgccggttattttgcttccggcaagcaaattaattacacaatgcaagagggttatttgttcagcaaatgacccattttctcggctttggtatcgagataatgttcgttattggggttacgacctacaatcaacggtacgcgttcaataatattaatccctgcttcggtcagaatttcgacttttttcgggttattggttaacaagcggacttcattgacgccaaggagtttgaacatatcagcgcaaagagtgaagtcgcgctcatcagcggcgaagcctaactggtggttagcctctacagtatcgtaaccttgatcctgcagtgcgtaagcgcggattttattcagcagaccaatgttacgaccttcctgacggtgatacagcaaaataccacggccttcctcggcaatttgcgtcaatgccgcttcgagctggaagccacaatcgcagcgcaagctgaacagggcgtcaccggtcagacattcggaatggacgcgcgcaagtaccggggtatgcccggaaatatcgccatagactagcgcgacatgatcgtgtccggttgccagttcttcaaatcccaccatcaggaaatcgccccatggggttggcagtttggcttctgccacacgtttaagctgcatgaaattctccagataatgctggttctgtattggcttattttgccataacgagaaggggttcacctaatcacgacgcgtcgatcgttcacggaatggcacaaatctgtcaatttttcctggaactggcattttcagttatgattgtgggacttatcaaaaaggagaggccatgcgttcgattgccagacgtaccgcagtgggagctgcactattgcttgtcatgccagtagccgtatggctttctggctggcgttggcaacctggagaacaaagttggttactaaaagcggctttttgggttactgaaactgtcacccagccctggggcgtcattacacatttgattttattcggctggtttctctggtgtctgcgttttcgcattaaggctgccattatgttatttgccattctggcggcggcaatccttatgggacaaggcgttaaatcctggatcaaagacaaagtccaggaaccacgaccttttgttatctggctggaaaaaacacatcatattccggttgatgagttctacactttaaagcgagcagaacgcggaaatctggtgaaagaacagttggcagaagagaaaaatatcccacaatatttgcgttcacactggcagaaagagacggggtttgcctttccttccggtcacacgatgtttgctgccagttgggcactgctggccgttggtttgctgtggccgcgtcggcgaacgttaaccattgctatcttgttggtctgggcaacgggagtcatgggaagccgcctgctgctcgggatgcattggccacgcgatctggttgtagctacgttgatttcgtgggcgctggtggcggtggcaacgtggcttgcgcaacgaatttgtgggccattaacaccacctgcggaagaaaatcgcgaaattgcacaacgagaacaagaaagttaacgctggttgattttccgaatttagcccttaaatcattaacaatgcgcgtggatgccatttcgcagacggcgcgaaaatggtactttaaagggctattgcggtaagttgaccataatttattcgctctaaccacataacgggaagtaatgtgaaatatttactcattttcttactggtgttagcgatcttcgtgatttcggtcacgttgggtgcgcagaacgatcaacaggtgacgtttaattatctgttagcgcaaggggagtaccgtatttccacattgctggcggtattgtttgctgcgggggttgctatcggttggttgatttgtggcctgttctggctgcgagttcgtgtttccctggcgcgcgctgaacgtaaaataaagcgactggaaaaccagctttcacccgcgactgacgtggctgtagcgccgcactcgtctgcgtcgaaggaataactttctatgctggagttgttgtttctgcttttgcctgtagccgctgcctatggctggtatatgggccgcagaagtgcgcaacaaaacaagcaagatgaagccaaccgcttgtcgcgtgattacgtagcgggggttaacttcctgcttagtaatcaacaggataaagcggtagacctgtttctcgatatgcttaaagaggatacaggtaccgttgaagcccaccttacgctcggaaacctgttccgttcgcgtggcgaagttgatcgcgctattcgcatccatcagaccctaatggaaagcgcctcgctgacctatgaacagcggcttttggcgattcaacaattggggcgtgattacatggctgccgggttatacgaccgcgcggaagacatgttcaatcagctgacagatgaaactgacttccgcattggcgcgctgcaacaactgctacaaatttaccaggctaccagcgagtggcagaaagcaattgatgttgccgaacgcctggtgaagctgggtaaagataaacagcgcgtcgaaattgcccatttctactgtgagttagctctgcagcatatggccagcgacgatctcgatcgtgccatgactttgctaaaaaaaggtgcggcggcagataaaaacagcgcccgcgtatccatcatgatgggacgcgtgtttatggcgaaaggagaatacgccaaagccgtcgaaagtttgcaacgtgtcatatcccaggacagagaactggtcagcgaaacgctggaaatgctgcaaacatgctatcagcagttgggtaaaactgccgaatgggcagaattcctgcagcgcgcggtggaagagaacaccggtgccgatgctgaattgatgcttgcggatatcatcgaagcgcgcgacggtagtgaggctgcgcaggtctatattacgcgccagcttcagcgtcatccgaccatgcgtgtgttccataagttaatggattaccacttaaatgaagcagaagaagggcgtgccaaagagagtctgatggtgctgcgtgacatggttggcgagaaggtacgtagtaagcctcgttatcgctgccagaaatgtggttttaccgcatataccctctactggcattgtccgtcttgtcgggcctggtcaaccattaaaccaattcgcggtcttgatggcctgtaatttttaaaaaaatccgattttagttacaacatactaattattgatgttctattgtgctccggcaccgacggcgcggaaaagcctgccagaggagaaatcgcaactgttaattttttatttccacgggtagaatgctcgccgtttacctgtttcgcgccacttccggtgcccatcatcaagaaggtctggtcatgacgttaactgcttcatcttcttcccgcgctgttacgaattctcctgtagttgttgcccttgattatcataatcgcgatgccgcgatggcctttgtcgacaagatcgacccacgcgattgtcgtctgaaggtcggcaaagagatgtttacattgtttgggccacagtttgtgagcgaacttcaacagcgtggttttgatatctttcttgacctgaaattccacgatattcccaacactgcagcgcacgctgtcgctgctgcggctgacttaggcgtgtggatggtgaatgttcatgcctccggtggggcgcgtatgatggccgcagcgcgtgaggcactggttccgtttggcaaagatgcaccgcttttgattgctgtgacagtgttgaccagcatggaagccagcgacctggccgatcttggcgtgacactgtcacctgcagattatgcagaacgtctggcggcactgacgcaaaaatgtggccttgatggtgtggtgtgttctgctcaggaagctgtgcgctttaaacaggtattcggtcaggagttcaaactggttacgccgggcattcgtccgcaggggagtgatgctggtgaccagcgccgcattatgacgccagaacaggcgttgtcggctggtgttgattatatggtgattggtcgcccggtaacgcaatcggtagatccagcgcagacgctgaaagcgatcaacgcctctttacagcggagtgcatgatgagtgattccaacagccgtctggtctactcaacggaaaccggacgtattgatgagccaaaagcggcccctgtacgccctaaaggcgacggtgtggtgcgtattcagcgtcagaccagtggacgcaaaggtaagggcgtttgcctgattaccggtgtcgatctcgatgatgccgaactgacgaaactggcagctgaactgaagaaaaaatgcggctgcggcggagcagttaaagatggaattattgaaattcagggcgataagcgtgatttattaaaatcaatgcttgaagcgaaagggatgaaggtaaaactcgcaggcggctaacataaaaagccacggatatatccgtggctttcgaatattttactgtgtgtattattcagttatttcgtactgaacaaaatcaagcgtattataattgcgagtcgataatcgacatttatttacgattatttaccgacctggtgaccaataacaccaccgacggctgcaccacctaatgtacccaacgtactgccatcggtcagtactgcaccgcctaatgcccctgcacctgcaccgattgcggtgttgcggtcccgtttagaccagttagaacaggcactcagagacattgccagggtaattgccagaacagccgcggtcatttttttgctcgttacaaacataatactctctcctgaatttatgattcacggaagtaagctctctataactataatagctaagaataagccaggtgaaattattccgtgaaatccgctcgcgcgcagggttatatcacgcaggtgataatgacttcctgttatatcgctgataataattttatatcttgagagtgttaataacaggtaaatagtcttaattatcaaccaggaatcatcttagagcggatgatttgccaaactgcaaatcatccgtagagaagggaaatggttaaatgtcaacgacgtgaacggtgagtttactttgttcaagatgcatcagatcgctggcgcgtattttcgaatcggtaatcacgcgattgaatcgctcaacggggccgatggagtatgaatgtacagcaccaaatttcgagctgtcagtcaggactatcgcctcgcactctttttccagcacggcattgaccacatcggtacgcatcatatcgcgaccggtaaacccagtttcaggttgccagccatcaataccaataaatgctttgctgaaatgcacttgttggatgcactggcgtgtcaaagggccaaccatactttcgctttttttctggtacacgccaccgagcaaaatgacttcacaaggcgcgtctttcagcaaatgcgcgatgtagctgctgaccgtgatgatagtgacatttttcttctgctcgcccagagtcctggcgagcagggcattgctgctaccattttcgataaagatggtttcgcccggttgaaccagtgacgcggcaaactcggcgagttcacgcttcagcgtatagttgctcatcatacgggtttcgacgtcatcactatcaagcgaaactgcaaaaccatgtgcacgtcggaggtaactcagtttttcgagggtgttgagatcctggcgaatggtaacttcagaaactccagtggcttttgccagatcggttacgctaacctgaccctggtcaatgaccatctgtagaatagtttgttgtcgggaattcatcgctgtaattcttataacgttataatactaaataaaaaaatactgacgcgccgggcatcctcaaataggaaaacctgaaggcacgattgttagatctcccacggtgccttcgggatgtctggcgtagattcagcaacctgacgcaagagttctgctttaagtatctcgagattatggatcgcagagtggtaatcgcctgccacaaggatatctaacacaatatcaatacgttcggcaacgcgctgggcatcaaattcagacatcaaggacatccttatagcaaaaggggaaaaatgaataatgcaaaaattgccgctaaaagagaagtgtttaacagcaacggctaattatcatccgggaatacgatatataatgacggaatatagcgctaagtatatatattcatctacttatgtgcgcttcagatagcgtttataccagcgttcgaaggcaacggcgggcatcggtttggcaaacaaaaatccttgtcgctcattgatcccgttcttggttaaaaaagcatcttcctttgcactttctacaccttcggcgatcacctgaagattcaatgcctgggccacagcgacgatcgcccggaccagtgattgcgagacaggctgtttgtgaatatcccgaacaaaaacctggtcaagtttgatggcatcgatcggaaagcgcgccagttgcgaaagtgaagagtagccggtaccaaaatcgtccagatgaacttgcgcacctaatcggctaaattgttgaataacagacagtgccagttcatcattctcaatcaggcagctctccgtcagttcaacatctatagggcagtattcaaaattgagttcctggagaacctgtttcagggcggtgaaaatggtttgatcggcgagctgacgtgcagaaatatttaccgccactcgcaggttaatgcctttatcccgccacttcgctacctggcgtacgacatcgagaatcacccaacggcctaaaggcacaattagccctgattcttcggcgtaggaaatgaagtccaacggtggaatcaacccacgttcaggtgactgccaacgtactagtgcttccagactgcgcacttcgccacgccaggtgattttcggttgatagtgaataaccaactgatcgttttccagtgctttacgcaagttggtatccagccagagatattcaaatacccgctgattcatttctggggtaaaaacgcaaaattgtcctcgtccgccttccttcgctgtgtacattgctgtgtcggcgtgacgaataatagccgcgctgtccgaaccatgttcgggagagagtgaaatacctactgaacagctggtataaacttcaattaaaccaatgcgaaaggggagtcgtaagcgggtcaaaattcgtgatgccaatgcttccagcgcgctttgtgaggtattggatgccagtaccagaaactcatcgccacctggacgcgccaacacctggtcatgttcgagacagcttaaaatagccaatgacacgtcgcgtaataactggtcaccaaacaaatgcccataggcgtcgttgacctttttaaaattatccaaatcaagatacacaaccccaactttattgttatctgcctgattaatagcgtgatcgattaactcctgcatcgcgttacgattcggcagtccggtgatactgtcggtatttgccagaatacgcagtcgctcctgagcgcggcgctcttcggtaatgtcggtgccggaacagattaaaaaaatctcgtttttgccactgccgctgtggacaaatttattgcgaaacagaaacagccgctggcctttacgtgttggtatccatagttcgacttcatatgcattgccgcttcgaaaaaatacacggttattgcgcctggatgccgcagcttcacgacgactcataaacagtttaaacacgctttgcccaatgacgtcgtgttctttcaaccctgtgtaatcttcacataaccgattgaagcgctggatattcccccggctgtcgagaatcactattgcggaatgtgcttcagaaactacctgctcagcaaaggaaagcccatgtgataaatcacgagcaaccgccgatgtgtcatgccatgcagacgcgttgcctccccattctcgtttattgatttttcgtcctaccagatgcacagaaagatcgctttcatcgacggtcagactcatcatcaggctggaggtgatgaccgtcatttccctgatgcgagcagcctgttcggcagatagttgcaaaatacgatcgggttctgtgatttcggtggtagaaaagcgcaaaacatcgctgctttccgtcaaccgccagtatggattgtgcgatccgagaaagttgtacaacgttgcggactccctaacggttttcatgatgcatatcctccggttaacagcggagtccgcagttaaataaaaggaacaacatgacttacatgaaattaacggcggctaaacacattgtttttttatatatttatttgtaatccagttttggaaaaacgccagttttcaaacgaaagtcagttaaaaatctgccgggatatgaggaaggttgagcggggaaataaacggcccatccatgaggaatgggccgtgaaaggagattacgcgactgggcgcgcaataatgctgcgggtttccatgcggacttcggcaatggtgacgtcaataacgtcagtcactttgtaagccgtttcacctttaatttgtacagtgccgttttcctggctgcaaaccagttcatcgcgcacagcgtgtaagaaaggtgctggaataaaggcgatagcgccgttatcaaccaaacgaacacgcatgccgccacggctgatatcgacaatttccgccgcgaaacgggtgtcggtcccggctttgtctttcaggaagcgtgcgtataaccagtcgccaacatcacgttctgccatccggttgagacggcgacgctcggccatttggacagtgatttcatcctgtggacgcgtcgcagtttcgcctttgataaccgctttcagcagacggtggttgatcatgtcgccatatttacggatcggcgaagtccaggtggcgtatgcttccagaccgaggccaaagtgaggaccgggttcagtgctaatttcagcaaatgactggaagcgacgaatgcggctgtcgaggaaaccagttggttgcgcatccagttcacgacgcagtttgcagaaaccgtccagcgtgagcacttcttcagcatcgacatgcagaccgtgcgttttcagcaacgctgccagcgcgtcggcattcgccggatcaaagcccatatgcacgttatagatgccaaaaccgagcttatcgcgcagtacgcgggccgcacaaatgttagcggcaatcatcgcttcttcgacgatacggttggcaatgcgacgaggctcggcaacgatatccagcacttcacctttttcaccgagaataaagcggtaatccgggcgatctttaaacaccagtgcgtggttatgacgccactcgccgcggcgttggcaaatttgtgctagcaaacggacttgttcggcaattgcttcgctttcaggctgccagtcaccggtattttccagccagtcagaaacctggtcatacaccagcttcgctttggattcgatggtggcggcaaagaattcgatattatcttcaatggtgccatcagtggagagcgtcatgcggcatgccagtaccgggcggacttcattggcgcgcagtgagcagagatcgtcagaaagctcgcgaggcagcatagggatgttgaagccaggcagatagttggtgaatgcgcgaattttcgcggctttgtccagcttgctgccttcagcaatccacgcggttggatcggcaatcgccacaatcagctgaagtttgccatccggtaacgccttggcgaaaagggcgtcatccatatcttctgtgctggcactgtcgatggtgacaaaatccagcgcagtcagatcttcacgaaccagaccttcatcgagcatttcggtagcgacgccgtctggtgcttctttttccagattatgacgcgcaagggtaacccaccacggtacaaagtgatcgtcaccaaaagtgatgtattgtgtcagttcagcatagaaagaacgatcgcctttcagcggatgacggcgcatttcggcaaccgcccagtcgccttctttaaactcgtggttcaggccacgggctgcgcggcaaggaatggcgtttaagagtggatgatcaggaacgatggccagacggtcatttttgccctgaactttacccacgaaacgagtcaggaacggttcaaccagttcttctggctctgcggattcacgttctttttcactgtggatcaccgcgataattcggtcgccatgcatgacttttttcatctgcggcggcggaatgaaataacttttttgcgcgtcgacttccaggaagccaaagcctttttctgtggcttttaccaccccttcagcgcgtggcgtctgggaatgcagttgctgtttaagctgcgctagcagcgggttgtcctgaaacataattgtctattttggtggccattagagcggctgacagttttacgcgaatctgtctgacgcggcaaggttaatatgtctcacccaacgcgatttttaagcgatttatccagccacacagcccgctccataccagcagattaataatctgcgttgatgatttttcgtgttcgagtaatgggctgaactgggcggcgctaaagcgatcgggtgctcgggtcagccattgtatcgcctgaacggtagcgcgctcaacagaatgacggtcagcccatcggttaatttcattttcgcccttgcgcagaagggggctgatttttttatattcatttgatgaattcatacaggcggcaaaacaagcaggactgccatttatccgcgcgcataacaacgccgcaagctgattatccggctgtgtattgacccgtgtgctgtttaacaacttttcgagaagggaaagtgaaatagggtggagagagagtgtgttggccagttggcaaagttctgcagttgaactttttgtgtgctcttcagggagtttttccacctcatagctgcttcgccagcgtaatgattcatcagcaaacagtgacgcgtcggcgtagttttgtatctccagcccgggtaaccagcgtaccggatgcccgagataagcctgaaatgtcgcaattgtccgcgcctgaaagccaataaaaccaatgatttggttaatgatcacacagtcacagacagtaagaccaacgtcattcagatgctggcgcgatcggttgtcgataatagaaggcgagctagccagttggcgggcatattgcgtgatttgtgccaaccgatgattactttccctggaggaatcaggcccggggagcggcgtaagtcgcgccgaatagtagttacataaccgttggacgccgcaaacctgagcaaccgtcagggccgtcgacaagcgttcataagcggtgaaggtctgtgaacgggtcacggtaagcgggtcagggaacaactctactgcaagaacgcgcgcagggaccagccatgaaaggaagggtgccagcgtttcttcatcaaggatcacgtcgagcagaaagggatcgctgacctttgcggcttccgggaccagaggcagaacgtcatactccgcagtactggattgcgtttcatgataccagtggcttttgccggtgatgtggcgttgttccatgggcgctccttggtcgtaaaggaaatcgttatcctgacgcaaggcgggaaggggagaaagacggatcggcgataacaaatatcagaaaggtataacagagataacgggcggcagaacgccgcccaatatttaccaacagaacgattatttcagttcgagttcgttcattgcagcgatgctgaaaccgccgtcaacgtggaccacttcaccggagataccggcagagagatcggagcacaggaatgccgcggagttacccacatcttcaatagtaacggtacggcgaatcggggtaacggcttcgcaatgagccagcattttgcggaagtctttgataccggaagccgccagagtacggatcggaccagcagagatggcgttaacacgcacaccttccggacccatcgcgttcgccatatagcgcacgttcgcttccagagacgcttttgccagacccataacgttgtaattcgggatagcgcgctcagcgccaaggtaggaaagggtcagcagggcagaacccggattcagcatggagcggcaagcttttgccattgcaacgaagctgtaggagctgatgtcgtgggcaattttgaagccttcacgagtaacggcgttaacatagtcaccatccagctgatcgccaggtgcaaaaccaatagagtgtacgaaaccgtcaaatttcggccaaactttccccagttcagcgaacatggtgtcgatgctggtatcttcggcaacatcgcactgcagaacgatgtcagaacccaattgagcggcaaattcttctacgcggcctttcagtttgtcgttctggtaggtgaatgccagttcagctccttcgcggtgcatcgcctgagcgataccgtaggcgatggacagtttgctggcaacaccggttaccagaatgcgcttaccggaaagaaaacccatagctttaatccttattgttgatgcttgttgtgcctgaaaatcaggcgattcgtcgttttagtaaacagtacgaacagataaacggttattataatcaacctggctgtgggtggctatagttgcgctttctgtagcggagagaagctgcggtacagagcattttgcgttatctactcctgacgcctgcaagggggaggttggggaaatatcttatagaatctgactttgaaactattcgtattagctccgataaatttgatgatgaaaacagaactggcgacaacaagtcgctgtctttctgatgaattgaccccaacttaatattgtcaactatcttcacagaatctccacaatctcttcattatcagaatatgcatcatgaataagataaaaatactttccattactttggagaaacgtataattagcaaaaatgagaacgatcattctcaccaagtgataggccaggagacagaaatgaccagcaagctggagatacgccacaaacagcgtcaggatgaaatcattaacgccgcccgtcggtgttttcgtcgctgcggatttcatgccgccagtatgtcgcaaattgccagcgaagctcagcttagcgtgggtcagatatatcgttacttcgccaacaaagacgccattattgaagagatggttcgccgtatcatcgactttcgtattgcccaaatggacattgacgcgcgtaccgatcacttcccggaagtccttgccttgcgtaaatccttaaatgaggacgacgacgcgctgatgctggaagtggctgcagaagccacacgcaacccgcgggttatggcaatgcttgaagaagctgacgccagaatgttcgctaacggttgtgcacatatgaaaagaatgcatccccatcttagcgacgagcacattcgttgctgcgttgaagtgtttgctaccatgatggaaggtacggtttatcgtcgtttaacaccgcaaaaaagcgatccacaacatctgcaggaaatatatcaggatattgttagtatgttgataaataaataagaacagaattaaccaatagcgggggatattaatcccccttatttcattgcgaaattcatttcgcgatgcgggttcgttataactgaatatccctgacatatcctcattaatttcaatgaggagggtatttctcaccctggagaaaataatgaagtatatagcaacatctgtagtggcaatgctgctcttatcgggttgtgataatacgcaaagtaacaattcatccccgtcagaaacagaagtcggcgttgttacgctcaaatctcaaccggtttcggtagtcagtgaattaaccggacgcaccagtgctgcgctcagtgctgaagtacgtccgcaggttgggggaattatccagaaacgcttatttaaggaaggtgatctggtcaaggctggacagcctctctaccagattgatgcggccagttatcaggctgcatggaatgaagcccgggcagcattacaacaagcacaggcactggtaaaagccgattgccagaaagcgcagcgttatgcccgactggtgaaagagaatggtgtttcacaacaggatgctgatgatgctcagtctacctgtgcacaagataaagccagtgtagaggcgaaaaaagccgcactggaaactgcgcgcattaatcttgactggaccacggtaaccgcaccgatttcggggcgtattggtatttcgtcggtaacccttggcgcactggtgaccgcgtcgcaggatacagcgttaacgactattcgtggtctggatacaatgtatgtcgacctcactcgctccagtgtcgatttattacgtctgcgtaaacagtcactggcgaccaacagtgacaccatgagcgtctcacttattctggaagatggcacaacctacagcgaaaaagggcgtctggaactcaccgaagtcgcggtggatgagtctaccggttcggtgacattacgggcaattttccccaatccacaacagcagttattaccgggaatgtttgttcgcgctcgtgtcgatgaaggcgtgatggaagacgctattctcgcgccgcaacagggcgtcacgcgcgatgctaaaggcaatgcaactgcgctggtggtcaataaagacaataaagtagagcagcgaacgctcgaaacgggagaaacgtatggtgataaatggctggtgctgaacggcctgcacaacggcgaccgactgattgttgaaggttctgccaaagtcacttcagggcagaccgtcaaggctgttgaagttcaggctaatggaggcaacgcctgatgttttcgcgcttttttgttcgccgcccggtctttgcctgggttatcgccattttgattatgttggcggggattctggctattcgcacattgcccgtcgcgcaatatcctgacgttgcgccaccgaccattaaaatttcagccacttatactggtgcttctgccgaaacgctggagaacagcgtgactcaggttatcgagcaacaactcactgggcttgataatttactctatttcagctcaaccagcagctctgatggttcggtcagtattaatgtgacctttgaacaaggtaccgatccagatactgcacaggttcaggtgcagaataaaattcagcaggcggagtcgcgcctacccagcgaagtgcagcaaacgggtgttacggtggagaaatcacaaagcaactttttgctgattgctgccgtgtatgacaccactgacaaagcctccagttcggatatcgccgactggctggtcagtaacgttcaggacccgctggcgcgtgttgaaggtgtggggagtctgcaagtctttggcgcggaatacgctatgcgcatctggctcgacccggccaaactggcgtcttactcgctgatgccttcagacgtgcaaagtgctattgaagcgcaaaacgtgcaggttactgccgggaaaataggggcattgccttcaccggatactcagcaactgaccgcaacggtacgtgcgcagtctcgtttgcagacggtggatcagttcaaaaatattatcgtgaaaagccagtcagacggcgcagttgttcgtataaaagatgtggctcgcgttgagatgggcagtgaagattataccgctatcggcaaacttaacggtcacccgtctgccggggttgctgtaatgctttcgcccggtgcgaatgcgctgaatacggcgacgctggtcaaggataagattgccgaattccagcggaacatgccgcagggatacgacatcgcatacccgaaagacagcactgaatttattaaaatctccgtagaggacgtaattcagacgctgtttgaagccatcgtattggtggtttgcgtgatgtatttattcctgcaaaacctgcgtgccacactgattccggcgttagctgtccccgtcgttttgctgggcacattcggcgttcttgcgttgtttggctattcgattaataccctgacgttgtttgcaatggtgcaggcgatcggcttgctggtggacgatgccattgtggtggtagagaacgtcgaacgcattatgcgtgacgaagggttgcccgcgcctgaagccacggaaaaatcaatgggcgagatttctggcgcactggttgccattgcgctggtgttgtcagccgtattcctgccgatggccttctttgggggatctacgggcgtaatttatcgtcagttctccatcaccattatctccgcaatgctgctttccgtggtggtggcattgaccttgactcccgccctgtgcggttccgtcctccagcatgttccaccacataaaaaaggctttttcggcgcatttaaccgcttttaccgccgtactgaagataaatatcagcgaggcgtaatttatgtcctgcgccgtacagcccgaacgatggggctttatgtcgtgctgggtggtggaatggccctgatgatgtggaaactgccgggcagtttcttacccactgaagaccagggcgaaatcatggtgcagtacacgctgccggccggtgcaaccgctgcccgtacagcagaagtgaatcgccagattgttgactggttcctgattaacgagaaagcaaataccgatgtcatctttaccgttgatggtttcagttttagcggcagcggacagaacaccgggatggcgtttgtttcgttgaaaaactggtctcaacgtaaaggggcagaaaacaccgcccaggctatcgccctacgggcaaccaaagagctgggcacaattcgtgatgccacggtatttgcgatgacgccgccagccgttgatgggctggggcaaagcaatggttttacgtttgaattgttagctaacggtggaaccgatcgtgaaacactgctgcaaatgcgtaatcagttgatagaaaaagcgaatcaaagtccggagttacattctgtacgcgccaatgatttgccacaaatgccgcaattgcaggtagatattgatagtaataaagcggtgtcattagggttgagtttgaatgatgtcaccgacaccctgtccagtgcgtggggcggtacttatgtgaatgactttattgaccgtggtcgtgtgaaaaaagtctacattcagggcgacagcgaatttcgttccgcgccgtcagacttaggtaaatggtttgtgcgcggtagcgataacgccatgacaccattctctgcttttgcgaccacccgctggctgtatggaccggaaagactggtgcgctacaacggctcggcagcctatgaaattcagggcgaaaacgcgactggctttagttccggcgatgcaatgacaaaaatggaggaactggcaaacagtcttcctgcgggaacaacctgggcctggagtggtttgtcattgcaggagaaactggccagcggtcaggcattaagtctgtatgcagtttctattctggtggttttcctctgccttgcagcactgtacgaaagctggtcagtcccgttctcggtcattctggtgatccctctggggcttcttggcgcggcgctggcggcctggatgcgtgatttaaacaacgacgtttacttccaggtagcgctattaactactatcggcttgtcgtcgaaaaacgccattctgattgtggaatttgctgaagcggcggttgcagagggctattccttgagtcgtgcggcattacgcgcggcgcagactcgtttacgcccaatcatcatgacctcgctggcgtttattgcgggggtaatgccgctggcgatagcaaccggcgcaggggcgaacagccgcatcgccattggtacgggcattattggcggcacgctgaccgctacattactggccattttcttcgttcctctgttttttgtactggtgaaacgtttgtttgccggtaaaccgcgccgtcaggagtaagttatgttgcgtcgttctcttatttttctggtgttgttgagtgcgggatgtgtctcgctcgatcctcactacagtacgcctgaatccccaatcccggcgaccttgccgggagcacaggaccaggggaaggcaatcagccatgactggcagcaggtgatccacgatccccgattgcagcaggtagtaaccattgcactgaacagtaaccgcgatgtgcaaaaagcgattgctgatattgactcagcacgggcgctctatgggcaaactaatgcgtcgttatttccgacggtgaatgcggccttaagttcgactcgcagtcgttcgatggcgaatggtacgggaacaactgccgaggctgacggcacggtgtccagttatacgttagatctgtttggtcgtaatcagagtttatctcgggcggcgcgggaaacctggcttgccagtgaatttacagcccagaacactcgtttaacgctgattgctgaaatcagcaccgcctggctgacactggcggctgataacagcaacctggccctggcaaaagaaacgatgaccagtgcagaaaactcattgaaaattatccagcgccagcaacaggttggcacggcggcagtgacagatgtcagtgaggcgatgagtgtttatcagcaagcgcgcgccagcgttgccagctatcagacacaagtgatgcaggataaaaatgcgctgaacttactggcaggtacaacgcttgcggaaaatctgctaccgggaacactggaaagcctaccggaacaaatgataagtctggttcctgcgggagtatcatctgatgttctgctgcgtcgcccggatatccaggaagcggaacataatttgaagagcgccaatgcagatattggcgcggcgcgggctaactttttcccgacgatttcgctgactgccagtgccggtgttggcagtgacgcattgtcgtcgttgttcagccacggaatgcagatctggtcatttgcgccatcggtcacattatcgctgttcactggcggaagtaatctggcgcagcttcgttacgcagaagcacaaaagcgtgggctcattgccacctatgaaaaaaccgttcagagcgcatttaaagatgtcgctaacgcactggcgcggcggaccacgcttgaagagcaactggatgcacagagccagtatgttaaagctgagcaacaaacggtcgatgttggcttgcgtcgctatcaggcgggtgttggtgattacctgaccgtgttgacggcgcagcgcagcttgtggagcgcacagcaggagctgctggcactgcaactgactgattttacaaaccgaatcacgctctggcagtcgctgggcggcggtatgtcatcactcaagtaaggaataatatggctagagtctctctttcatgggcattgattcttggtcttttagccggtatcggcccgatgtgtaccgatctttatttgccggctttgccggagatgtctgagcaactggcggcaaccacgaccataacgcaattaaccctgaccgcatcactgattggtcttggcgtcggacaactgttatttggccctctgagcgacaaaatagggcgtaaacgtccgttaatcttgtcgttgttattgtttattgtttcttccattttgtgcgcgacaacgaacaatatttactggctggtggtctggcgttttattcaagggatcgcgggggcgggtggttcggtgctctctcgttctattgctcgtgacaaatatcagggagtaacgttgacccagttttttgcgatgttaatgacggtgaatggcctggcaccggtgttgtcgccagtgctgggcgggtacattgtcagcacttttgactggcgcactttattctgggtaatggctgaaattagcaccgtactgttgctgggctgcctgttatttattaatgagaccttgccagaaaataaaaggggctcatcattgctattaaccggacgaagcgtggtgcagaaccgccgttttatgcgcttttgcctgattcaaagttttatgctggctggtttgtttgcatatatcggctcttcgtcgttcgtgttgcagaaggaatttggctttagtccaatgcaatttagcctggtgtttggccttaacggcatcggacttatcattgcttcatggatcttctcgcgcctggcgcgacggattaacgcgatgacattgttgcgaggtggcctgatagcggcaattttgtgtgcattgctcacggtcttatgcgcatgggtacaattgcccattccggcactggtggcattatttttcaccatcgcattttgtagcggcatcggcactgttggcggggcagaggctatgagtgcagtagggacgcaggaatctggaacggcgtctgcgttgatggggatgagcatgtttgtcttcggcggtatagccgcgccattgtcgggaattggcggagaaacactgttaaaaatgagtctggcaattacggtgtgttatacgctggcattgctggttgctctcaccagaatcgacaatcaaaagtaatgaacacctcatcctgaggggggcctgtcaggatgaggtgcaaaacactaacggtccttacgccacgcatccgccgtcaatgcttcgccaaaatgaccggcgatcagccgtttggtgagttcatgcagcggcgatgccagcacatcagcggtgctgcctcgctcgacaacctcgccctgatgcatcaccagcacctggtcgctaatgtgcttcatcattccgatatgctgggtaacataaatatacgaaatgccctgtttttcctgtaactccagcatcagattaatcaactgcgaacgcatcgacatatccagtgaggcgagggcttcatcggcaataatgacttttgggcgcaatatcagcgcgcgcgccagacccagacgctgtttttgcccgggtgctaacatatgcggatagtaactgacgtgatccggtagcagcccaaccatacgcatcgtttcaataatctgtttgcgacgctgttccggttccaggtcggtgttcaggcgcagtggaaaatccagaatttgcgagatacgttgacggggattcaacgaggtcgaaggatcctgaaaaatcatgcgaatacgctgactgcggaaggaataatcgccaaaatgcagcggatgatcgtcaatcaataactcgccgctggtaggttctatcattcccgccagcatttttgccagcgtggatttacccgaaccattctcgccgataatcgccagtgtctggccttcacgtagcgtaaagctcaagggttttaccgcttctacggtctgacgacgaaaccagccggtccggtagcggaacgttttacttaaattgcgcacttcaagtagcgtttcgatcatctcactctttctccatgttcagtgggaaatgacaggcatagagatgatttttcgtccccgtcaaacgtggcgtcacaatgcattctcgttgtgcatacgggcaacgtggccccagacgacaaccaatcggtaactgttccagcagcgggatagcgccgggcagcgtattgaggcgacttttatgcggcatcgcgctgccgaagtctggtatcgcgcggatcagcgcctgggtataaggatggtgtggcatcgtcaccaactccttactcggcgcggtttccaccgtttgaccgcagtaaagcacgttaattttatccgcccattggctaagcatttgtaagtcatggctgataagcaaaatagtggtattgctgttttggttgagacgcgtcagcaggcgaaagatttgcgcctgggttgttggctccattgagttggtcggttcgtcagcaattagcagacgcggttgattcgccagtgcaatggctatcatcactttctgacattcaccttcggtcaactcatagggaaaactgcgcatcgcatctttgtgatctttaatccccacgcggtgcagcagttcaatggcacggcgtttgcgccagccaaaacgctgccaccaacggcctttataggtccaggcagggatgttttgcatcaactggcgacccacacgttctgaagggtcaagacacgactgtggttcctggaaaatcatcgacacgttgtgaccaaccagcttgcgccgttcgcgtgcggagagacgcagcaaatcgatatcatcaaaacgcatacggtcagcagtaacacgccagttatctttattcaccccacaaatcgcttttgcaatcaaacttttgccggaaccggattcgccaacaagaccgcggatttcaccttcggttaaggtcatacttacgcggtcgacggctttaacccactcatcaccggttttaaattcaatggtcaggttacgaatatcgagtaatggcattattccacccccgcaataattgcacgacggacaccgtcgccaaggaggttaaccaacagcacgctaatcataattgccgcacctggcagcatgacagtccatggggcgacataaatcagttccagcgcatcaccgagcatcgcgccccattcaggcgaggggagttgtgcgccgagatcgagaaagcccagcgcggcgatatcgagaattgccatcgacaatgcgcgagtgatctcggtgaccagtccggcagtgatgttgggcatcacagcaaaccagagaatattcagcgttgatgcgccatccagacgggcggcgataacgtactctttttccagttcgtcatgcaccatgctgtaaatcgaacgtaccatacgcggcagcaatgccagccagacagcaaacatggcgtgagacaaactcggtccggcaaacgctacaacgataattgccagcagcagcgaagggatcgccagtaaggtatccagaatatggttaagcaccgctgagcgtaggccgtgggtcgccccggcgaaggtgcccagtaccaggccacagatcgtcgcggcaagcgtcaccacaaatgcgccacctacggttggcgcagctccgctcagtaaacggcttaaaacatcgcgtccgaggtcgtcagtccccaggaagaaagaaacttcgccatagcgcgaccatgacggcggcaataattgataaccgagaaattgctggtcaatgccgtaaggcgcaaaccagccgccaaaaatacacagtacagccagccccgcacagccgtacaggccgaccatcgcagaggcgtcactataaaatttgcgccaggcggtacgcagcgtgcccggcgggcgcttttcgctgtatacgctatcgtaaggcataccattccttatgtttcagagggttagccatggcacccaaaatatcagaaatcacgttaacaataatgaccagtgagccacacaccatcactccggcggaaatggctgcgtaatcctgctggcggatggcgttaattaaccagcgccctaaacccggccagctaaaaaccatttcggtgatcatcgccagcgtcagcatggtggaaaactgtaagcccaggcgaggaataaccggaggtaacgcgttatgcagaacgtggcgacgcaaaatagtaaagcgcgacaaaccgcgggttgccgctgctttaacatagttctggtcatacacttcgatagtgctgatacgcatcagtcggatcacttcagttgttggcgcaaccgacagggtgagcacgggcaataccatatgacggattgcgctcatgaccatttcatcccgccacggtgagtccgaaagccaggcatcaatcaacgcaaaaccggtaatcggtttcacttcgtagagcaaatcgaaacgcccagaaacgggcaaccaacctagcgtgagtgaacaaaacagcgtcagcagaagcgccagccagaacaccgggattgaaaagcccagtaaggcgatggcgttgatcaagttatcctgccacttatggcgcgtaatcccggcaatcatccccacggggatgccaacaatcagcgcaaaaccgaaggcgaggatgcacagttccatcgtcgccgggaagacctcttttaactgttcggcaatcggttgaccgttaatgctggaaacaccaaaatcccagtggatcaggccgttaaaccagaacacccaggcattccacagtgacgcgccttgtaacggcgcatgtggggtgaaatagctcaagctgaagccaacgaaggtcagcaggaacaaggtgacaatcaataacaaaatacggcgcaaggtgaagataatcatggctttttcacctcatcctgtttctcgcgatacaccccagcaaaggaggcgttaccaaacgggctaagtaccagacctttgatatcgtaccgataggcctgcaaacgcaatgacgacgccagcggcagaataggtaattcctgcgccagaatactttgcgcttcgtcataggcttcaatacgcgccgccagctgctgcgaggagagcgccttacgcaacacgctgtcgaatttcggatcgcaccagtgggcgaggttggtctgcgaatgaattgctgcgcagctcagtaacggacggaagaaactgtccgggtcgttactgtccgtcgcccaaccggataacgtcagatcatggctcatatccatcaaccgcgcctcctgaaaacgaccttctaccggcacaatcaccacttttacgccaacctgtgccatatccgcctgaatcagttcggcggttttcagtggactggggttccacgcctgcgaacgtgtgggcacccacagtttcagcgttaagttttccagccccaacgccttcaactgttcgcgcgattttgccggattgtattcagtaattttagcctcgttgtcataggcccacgaggctcgcggtaaaatagaggcagccgtttcagccgtaccataatagatggattgcatcaggcgctggttattaatcgccagtgccagcgcatggcggaccgccggattatttagcggcggtttggcggtgttgaatgccagataggcgacattcatcccaggacgcagcgttaaacgcaagcgtgggtcgtcacgcaaaatggatagctgactggcagcaggccaggccagaacgtcgcactccccggtcaggagtttcgacaatcgtcctgtaccgccagagcctaaatctaccaccacttgtggcatcaacggcttaccacgccagaaatcatcatgacgttgtaagcgaatatattgcccggcgcggtattccgacaactgatacggaccggtgccgaccggttgacggtcgagttgctcctggcgatcttctttctctaacttccctgcatattctgccgacatgaccgaagcataatgggtcgccaggtgccacaaaaaagaagcatccggctgggcgagacggaactcaacggtatgattatccagcttgcggacgcttttcacgttatcggcaaattgcagactgtcgaaataggggaagttactgccgttgacgttatgccacgggttgttgcggtcaaaaatccgttggaaggtaaacaccacatcatcggcattcattttacgagtgggagtaaaccagtcggttttttgaaacggaacatcgcgacgcaggtggaagcgataggtcgcgccgttgtcgagtacttcccagctttcggcaagttccggcatcaggcgataggtatagggatcgacatccagcagtcgatcataaaactgggcggcaagggtatcgacaattaacccactgctcgctttggatgggttaaaggtgttgacttgcccgctgacgcaatagacaaaaccgctgtcgcggatatcagcatgcgggggggattcaggcgcggcgattgcctgaccactcacaagtccagcaatcaccaaaagagacgataatacctggcgcataatattaagggattttatgtaaagaggctatcttactaatatttaatgacatttgccattaccgtttgtgttcagaggtcgtaatgagggccgtgtggttggtcattgaacaggtggcgtcgccatcagttcaacattcgtacccgtgatttctttataactataactcacagaacaacttagcgaggagcagagcggtacgatcgtgagaaacccattaaagcacgctgctgtgcgtgtcatttttagccggatgcggcgcgaacgctttatccgggcaacgatactgaccgatcgtctgcaattaaataattactcattaccccattgattcaaaaactctgcgatctcatcaatgcgtacgggattaatccccgcttcagcagccatttcatgttgggcttcttcactgatctcttcattgttcatcaaacgggtgagcagtaactggaagtagtgggccagtggtgtgcgttcagcgtctgcgacaggctctgcgcattcggtcgcgtactcatcggcaatatcaaaatattttagcgggatatcgtggttcattatttgcccctggggttaatgcgctaagcataaaggcggatgatagcactcgtgatccgggtcatacatatttttatagttaatggcgcggtgcattaccctcaggcaggataatgcgccgcgcattcgactattacgtttcgctcaccggcgttctgtcgccatcatacaacggcactttgcgatagcggcggatcaaataccacaaatatgcgccgcctaacgaagcccataccatcccggttgcgcaattcgatgcggcaatgaaaattttgcaggatgcgctgagagattaatacgcagaagcagggttaacgcaataatgcctgatgcgcagcgcttatcaggcctgcaaacgacgtattgattatgtatgccggataaagcgttcacgctgcatccggcaagttgtattgcccaacttcgctaaatctggtgctttttcaacaacgcgcggaactgatgataggttaaccccagcaattcagcggcgcgcttctggttatatttcccctgttgcaaactgagttgcagcaactctttttcctgctgcatctgaaactcgcgtaaatccagtggcagcgtcggaagcgaggtgttttctgaaacggcgatggcttcttcagatggacggcgtttaaagggatcaataatgatgtcatcaagcggataatcgctggtgccgtgacgatacactgaacgttccaccacgtttttcaattcacgtatatttcccggccagcgataattcagcaatgtttctctggcgtgctcggtaaaacccgggaacagaggcagcttgatttcccgacacatctggatggcaaagtgttctgccatcaacataatgtcgctttcacgctcgcgcagtggtggcagttgcacaacatcgaacgctagtcggtcgagcaggtcagcgcgaaaagtaccttcattgaccatcgccgggagatcggcattcgtcgcgcataccaaccgcacattcacctgcaatggttggctgccgccgacgcgctccagttcaccgtactcaatcacacgcaataatttttcctgcaccatcatcggtgccgtagcgagttcatcaagaaatagcgtaccgccgtcggcacgttcaaatctccctggatgacgtttttgcgcaccggtaaacgcccccgcttcatgaccaaacagttcggaatccagcaaattttcatttaacgccgcgcagttaagggaaataaacggcccttgccaacgggaggagagataatgcaggcggctggcgatcagctctttaccggtgccgcgctcgccgatgatgagcaccggtttgtccagcggtgcgagatgcgaaacctgttccagcacttcgagaaagctgttcgcctcaccgagtaaattatctttgtattctgccatgatgaaattcgccacttgttagtgtaattcgctaattcatcctggcatgttgctgttgactcttcaatcagatctttataaatcaaaaagataaaaattggcacgcaaattgtattaacagttcagcaggacaatcctgaacgcagaaatcaagaggacaacattatgggtattttttctcgctttgccgacatcgtgaatgccaacatcaacgctctgttagagaaagcggaagatccacagaaactggtgcgtctgatgatccaggagatggaagatacattggttgaagtacgttctacttcggcgcgtgcgctggcagaaaagaaacagctgactcgtcgtattgaacaagcgtcggcgcgtgaaattgaatggcaggaaaaagcggaactggcactgctgaaagatagagaagatctggcgcgtgcggcgttaattgaaaaacagaaactgaccgatctgattaagagcctggaacatgaagtgacgctggtggacgatacgctagtgcgtatgaagaaagagatcggcgagctggaaaacaaattgagtgaaacacgcgctcgccagcaggcattgatgttacgccatcaggcggcaaactcgtcgcgcgatgtgcgtcgtcagctggacagtggcaaactggatgaagcaatggctcgtttcgaatctttcgaacgtcgaattgaccagatggaagcggaagcagaaagccacagcttcggtaaacaaaaatcgctggacgatcagtttgccgaactgaaagccgatgatgcaatcagcgagcaactggcacaattaaaagccaaaatgaagcaagacaatcaataataacatccaggcggcgtccgaacgcgccgccgctcatcgtctaaggagtccttatgagcgcgctatttctggctattccgttaaccatttttgtgctgtttgttttaccgatctggttatggctgcattacagcaatcgttctggtcgcagtgaattgtcgcaaagtgagcagcagcgattagcgcaactggctgatgaagcaaaacggatgcgcgaacgtattcaggcgctggaatctattcttgatgcagaacatccgaactggagggatcgctaatggcgggcattaatctcaataaaaaattatggcgtattccgcagcagggcatggtccgtggcgtctgcgccgggattgccaactattttgatgtaccagtaaaactggtgcgtatcctggtggtgctgtcgattttcttcggtctggcgctgtttaccctggttgcttacatcattttgtcatttgcgcttgatccaatgccggacaacatggcctttggtgagcagctaccttccagccgcgaattgctggatgaagtcgaccgtgaactggcggcaagtgaaacgcgtttacgcgagatggaacgttatgtcacttccgatactttcacgttacgtagccgtttccgtcaactgtgaggaaagttatgaatactcgctggcaacaggccgggcaaaaggtgaagcctgggttcaaattagcaggcaagctggtacttcttaccgcactgcgctatggcccggcgggtgtggcgggctgggcgataaaatcagttgctcgccgaccgctgaaaatgttgctggctgtggcgctggaaccgctgttaagtcgggctgccaataaactggcgcagcgttataaaaggtgaggggagtttcgcaaaaatggttaaatctcaggcgtataatggatagcaattttcatccatagaaggacgcttacatgtttaaaaaaggcttacttgctctgacactggtgttttcactgcccgttttcgccgctgaacactggatcgatgttcgtgttccagagcagtatcagcaagaacacgttcagggggccatcaatattcccttgaaggaagtgaaagagcgcattgccaccgccgttccggataaaaacgacaccgttaaagtgtattgcaatgccggacgccagtcagggcaggcaaaagagatccttagcgagatgggatatacccacgttgagaacgccggtggcctgaaagacatcgcaatgccgaaggtcaaaggttaaaagaattcaccatgagcggcgcttatgcgccgttttttctgtcacaccctatttacatccccatagattatttgcgttagctcacaaatacgctttttcccaggtaaaaaaagatttcctgcgtgactaaaccccttgagctcaattgacagtttattttatgcggagtagtctctcgtttcatgggaccgctaccacggaaaggcaacatgaaacagaaaattacggattacctggacgaaatctacggtggaacatttaccgcgactcatttacagaaacttgtaacgcgtcttgagagtgcgaaacgattaattacacagcgacgtaaaaaacactgggatgaaagtgatgtcgtgttaattacctatgccgatcaatttcacagtaatgatttaaagccactacccacatttaatcagttttaccctcaatggctgcaaagaattttttcacatgttcatttattacctttttatccatggtcatctgatgatggattttcggtaattgattatcatcaggtcgccagtgaagcgggggagtggcaggatattcagcaactcggtgaatgcagccatttaatgtttgattttgtctgcaaccatatgtcggcaaaaagtgaatggtttaaaaactatttacaacagcagccaggttttgaagatttttttattgccgttgatccgaaaaccgatctcagcgccgtcactcgcccgcgtgcgttaccgttattaacgccattccagatgcgcgatcattcaatgcgccatttatggaccacctttagcgatgatcaaattgacctcaattaccgtagccctgaagtgttgctggcgatggtggatgtattgctgtgctacctggaaaagggcgcagagtatgtccgtctggatgccgttggctttatgtggaaagagccgggaacaaactgcatccatctggaaaaaacacatctgattatcaaactgttacggtcgattattgataacgtcgcgccaggcacagtgatcattaccgagaccaatgttccgcataaagacaacattgcttactttggcgaaggcgatgacgaagcgcatatggtgtaccagttctcgctgccgccgctggtgctgcatgcggtgcaaaaacagaacgttgaggcactttgtgcgtgggcgcaaaacctgacactaccttccagcaacaccacctggtttaacttccttgcctctcacgatggcatcgggcttaacccactgcgggggttgttgcccgaaaacgaaatattagcgctggtcgaggtgttacagcaggaaggagcattagtaaactggaaaaataatcccgacggtacgcgtagcccctatgaaatgaatgtcacctatatggatgcgttgagccgccgtgagtgtagcgacgaagaacggtgtgccaggtttattctcgcccatgcgattttgttaagtttccccggtgtgccagcgatatatattcaaagcattctggggtcgcgtaatgattacgcaggtgtcgaaaaacttggatataatcgtgcgattaaccgtaaaaaatactctagtaaagagataacgacagaactgaacaataaagcgacattaagttattcggtatattataagttgtcgcatttaattacacttcgtcgcagtcataaagagtttcatccggataataatttcaccattgatgcgattaattcatttgtaatgcgaattcaaagaagcaatgcggatggcgattgcctgacgggattgtttaatgtcagtgaaaatattcagcatataaatattactgacctgcacggtcgggatctgattagtgaagttgatatattgggtaatgaaataacactgcatccctggcaggttatgtggattaaataaaaaggaacatttcatgattaaatcaaaaatcgtgctgttatcagcactggtttcctgcaccctgatttcaggctgtaaagaagaaaataaaaataatgtatccatcgaatttatgcattcttcggtggagcaggagcgccaggccgtcatcagcaaattgattgcccgttttgaaaaagaaaacccaggtatcaccgtaaaacaagtgcccgtggaagaagacgcctataacaccaaagtcattaccctttcacgtagcggttcgctgccggaagtgatcgaaaccagccatgactacgccaaagtgatggacaaagagcagcttatcgatcgccaggcggttgccacggtcatcagcaacgtcggtgaaggcgcgttctacgatggcgtactgcggattgtgcgcaccgaagatggcagcgcctggaccggtgttcctgtcagcgcatggattggcgggatctggtatcgcaaagatgtgctggcaaaagctgggctggaggagccaaaaaactggcagcaattgctggacgttgcacagaaactgaatgacccggcgaataaaaaatacggtattgcgctgcctacagcagaaagcgtgttgacggaacagtctttctcccagtttgcgttatccaatcaggctaacgtctttaacgccgaaggcaaaatcacccttgatacaccagagatgatgcaggcgctgacctattaccgcaaccttgctgccaacaccatgccaggttctaacgacatcatggaagtgaaagacgcttttatgaacggcaccgcgccgatggcgatttactccacctatatccttccggctgtgattaaagaaggcgatccgaaaaacgtcggtttcgtggtgccaaccgagaaaaattctgcggtctacggcatgttgacctcgctgaccattaccgccgggcaaaaggccgaagagacggaagcagcagaaaaatttgtcacctttatggagcaggcggacaacattgccgactgggtgatgatgtcgccaggcgcggcgctgccggtgaacaaagcggtggtgactaccgccacctggaaagacaacgacgttattaaggcgctgggagaattgccgaatcagctaatcagcgaactgccaaatattcaggtctttggcgcagtaggggataaaaactttacccgcatgggcgatgtgacggggtctggcgtggtgagttcaatggtgcataacgtcaccgtggggaaagccgatctccctggcacgctgcaagcgagccagaaaaagctggatgaactgatcgaacagcactaaacccaggacaggaatccgcaatgaacaggcttttttcaggtcgttccgatatgccttttgcactgctgcttctcgcgcccagcttattactgctgggcggtctggtggcgtggccgatggtgtcgaatatcgaaatcagttttttacgtctgccgctcaatcccaacatcgaggcaacatttgttggggtgagcaactatgtgcgtattctctccgatccgggcttctggcattcgctgtggatgacggtctggtataccgcgcttgtggtggcgggcagcaccgtgctcgggctggccgtggcgatgtttttcaaccgcgagttccgcctgcgcaaaaccgcgcgttcgctggtgatcctttcctacgtaacgccgtctatttcgctggtgttcgcctggaaatacatgttcaacaacggttacggcattgtgaactacctcggcgtcgatcttctgcatctctatgagcaggcaccgctgtggttcgataacccgggcagtagttttgtgctggtggtgctgttcgctatctggcgctacttcccgtatgcctttatctcgtttctggcgattttgcagaccatcgacaaatcgctgtacgaagcggcagagatggatggcgcgaatgcctggcagcggtttcgcatcgtcacgctgcccgcgattatgccggtcctggcgacggtggtgaccctgcgcactatctggatgttctacatgttcgcggatgtttatctgctgacgaccaaggtcgatattctcggtgtctatctctataaaaccgcctttgcctttaatgacttagggaaagcggcggcgatctcggtggtgcttttcatcattattttcgctgtcattctgctgaccaggaaacgggtgaacctcaatggcaacaaataaacgcacactcagtcgaatcggtttttactgcgggctggcgctgtttctcatcatcacgctgtttccattttttgtgatgctgatgacctcgttcaagagcgcaaaagaggcgatctcgctgcatcctacgctgctgccacagcagtggacgctggagcattacgtcgacatttttaatccggtgattttcccgtttgtcgactacttccgtaacagcatggtggtgtcggtggtttcatccgtggtggcggtatttctcggcattctcggggcttacgcgctttcccgcctgcgctttaaagggcggatgaccatcaacgccagcttttacacggtgtacatgttctccggcattttgctggtggtgccgctgttcaaaatcatcaccgcacttggcatttacgacaccgagatggcgctgatcattaccatggtgacgcaaaccctgcccaccgccgtgtttatgctgaaaagctacttcgacaccatccctgatgagatcgaagaagcggcgatgatggatggcctcaatcgtctgcaaattatcttccgtatcaccgtgcccctggcgatgtccgggctgatatcggtgtttgtctactgctttatggtggcgtggaacgactatctgtttgcgtcgattttcctctccagcgccagcaatttcaccttaccagtgggcctgaacgcgctgttcagtacgcctgattacatctggggacggatgatggcggcctcgctggtgaccgcattgccagtggtgattatgtatgcgctttcggaacattttattaagagtggtttgaccgccggtggcgtgaagggctaaagcggccagtttcttgataaggagttttacatgaaaaagttagtagccacagcaccgcgcgttgctgcgctggttgagtatgaagatcgggcgatttcagccaatgaagtgaagatccgcgtgcgattcggcgcaccgaagcatgggacggaagtggtcgatttccgcgctgccagtccgtttatcgatgaagactttaacggcgaatggcagatgttcaccccgcgtccagcagatgcgccgcgcggcattgagtttggcaaattccagcttggcaacatggtggttggcgacattatcgagtgcggcagcgacgttaccgactacgcggtgggcgacagcgtatgcggctacggcccgctttccgagacggtcatcattaacgcagtgaataactacaagctgcgcaaaatgccgcaaggcagctcctggaaaaacgccgtctgctacgacccggcgcagtttgccatgagcggcgtgcgcgatgccaatgtacgcgtaggggattttgtcgtggtggtcgggcttggcgcgatcggtcaaattgccatccaactggcaaaacgcgctggagcgtcggtggtaattggagtcgatcctattacccgtcgttgtgatattgcccgtcgccacggtgcggatttctgtcttaaccccattggcgctgacgtaggtaaagagatcaaaacgctgaccggcaagcagggtgccgatgtgattatcgaaaccagtggctatgccgacgcgctgcaatcggcactccgcggtctggcctatggcggcaccatctcctatgtcgcgtttgctaaaccgtttgccgaaggttttaacctcggacgcgaagcccatttcaataacgccaaaattgttttctcccgtgcgtgcagcgagccgaacccggattatccgcgctggagccgtaagcgtattgaagaaacctgctgggaactgctgatgaacggttatctcaattgcgaagatttaatcgatccggtggtgacctttgccaacagcccggaaagctacatgcagtatgtcgaccagcatccggaacagagcatcaaaatgggcgtcacgttttaattcaaaggaatgataaaaatgaaaatcggcacacagaatcaggcgttctttccggaaaacattctggagaaatttcgttatatcaaagagatgggtttcgatggttttgagatcgacggcaaactgctggtcaacaatctcgaagaagtcaaagcagcaatcaaagaaaccggtttaccggtgaccaccgcctgcggtggctatgacggttggattggcgactttatcgaagagcgtcgacttaatggcttaaagcagatcgaacgcattcttgaagctctggcagaagtgggcggtaaaggtatcgtcgttcccgctgcgtggggcatgtttaccttccgcttaccgccgatgacctcgccgcgtagcctggacggcgaccgcaaaatggtgagtgattccctgcgcgtactggagcaggtggcagcgcgtaccggaaccgtggtgtacctcgaaccgttaaaccgctatcaggatcacatgatcaacaccctcgccgatgctcgtcgttacatcgtcgaaaacgatcttaaacatgtacagattatcggcgatttctatcacatgaatatcgaagaagataacctggcgcaggcgttgcacgacaaccgcgacttgctcggtcatgtgcatattgccgataaccatcgctaccagccgggcagcggcaccctcgatttccacgcgctgtttgaacagctgcgcgccgataactatcagggctatgtggtgtatgaagggcgtatccgggcagaaaatcctgcccaggcgtaccgtgattctttggcttggttgcgtacctgctaagaggtctttgtgaaaagtgcaatgacaagctctccactgcgggtcgcgataatcggcgcaggccaggtggcggataaggttcatgcttcgtactactgcacccgcaatgatctggaactggtggctgtctgtgacagccgcctttcccaggcgcaggcgctggcagaaaaatacgggaatgcatccgtgtgggacgatccgcaggccatgctgctggcggtgaaacctgatgtggttagcgtctgctcacctaaccgttttcattacgaacataccctgatggcgctggaagcgggctgccatgtgatgtgcgaaaaaccgcccgccatgacggcagaacaggcgcgggaaatgtgcgataccgcgcgcaaacagggcaaggtgctggcctacgactttcaccatcgttttgcgctcgatacgcaacagctgcgtgaacaggtgaccaacggcgttttgggagagatttacgttaccaccgcccgcgccctgcgtcgctgcggcgttcccggctggggtgtctttaccaataaagaactgcagggtggtggcccgctgatcgacatcggcattcatatgctggatgcggcgatgtatgtgctgggctttccggcggtgaaaagcgtgaatgcgcatagttttcaaaagatcggcacgcaaaagagctgtggtcaatttggcgagtgggatccggcaacttatagcgtcgaagattcgctgtttggcaccattgaatttcataacggcggcattctgtggctggaaacgtcatttgcactcaacatccgcgaacagtcgattatgaacgtcagcttttgtggtgataaagccggtgcgacgctgtttccagcacatatctacaccgataacaacggtgaattaatgacgctgatgcaacgggaaatggcagacgacaaccgccatttgcgcagcatggaagcctttattaatcacgtacagggcaagcccgtgatgatagccgacgccgagcaggggtacatcatccagcaactggtggcggcgttgtatcaatccgcagaaacagggacgcgtgtggaattatgaccaggccagtaacgttatcagaaccccatttcagccagcatacactgaacaaatatgcttcactgatggcgcaggggaacggctatcttgggcttcgcgccagccatgaagaagattacacgcgccagacgcgcggcatgtatctgacggggctgtatcatcgggcgggtaagggtgaaatcaacgaactggtgaacctgcctgatgtcgtggggatggagattgccataaatggtgagattatctcgttatcccgcgaagcatggcagcgtgagcttaactttgccagtggcgaattacgtcgcaacgttgtctggcgtaccagcaacggcactggttacaccatcgccagccgtcgctttgtttcggcagaccaactgccgctgatcgcgctggaaatcagtattaccccgctggacgccaacgcgtcagtgctgatttcaacaggcattgacgccacgcaaaccaatcacggtcgccagcatctcgacgaaacccaggtgcgggtgtttggtcagcatctgatgcaggggatctacaccacccaggatgggcgcagtgatgtggccatcagctgttgctgtaaggtgagcggtgatgtgcagcaatgctataccgccaaagagcgccgtttactgcaacatacctgcgcgcagcttcacgcaggtgagacgttgacgctgcaaaaactggtgtggatcgactggcgggacgacagacaagccgctttagacgaatggggcagtgcgtcgcttcgtcagcttgaaatgtgcgcgcagcagagttacgaccaacttcttgcagcatcaacagaaaactggcgtcaatggtggcagaaacgtcgtatcacggtaaacggcggcgatgcgcacgatcagcaagcgttagattatgcgctttatcacctgcgcatcatgacgcctgcccacgatgagcgcagcagcattgcggcgaaaggtttaaccagcgaaggctacaaaggccacgttttctgggatacagaagtatttttgctaccgttccatctgtttagcgatccgacggttgcccgaagtttactgcgttatcgctggcacaacttgcctggcgcgcaggagaaagcgcgacgcaacggctggcagggcgctctgtttccgtgggaaagcgcgcgtagcggcgaagaagagacgccggaatttgctgccattaacattcgtaccgggttgcggcaaaaagtggcctctgcgcaggcggaacatcatctggtggccgatatcgcctgggcggttattcaatactggcggaccacgggggatgaaagtttcattgctcatgaaggcatggcgctacttctggagacggcaaagttctggattagccgcgcggtgagggttaacgaccgtctggaaattcatgatgttattgggccagatgaatataccgaacatgtcaataataacgccttcaccagctatatggcgtattacaacgtccagcaggcgctgaatatcgctcgtcagtttggctgtagcgacgacgcgtttattcatcgtgcagaaatgtacctcaaagaactgctgctgccagaaattcagcccgacggcgttttgccgcaggatgattcgtttatggctaagccggtgattaatctggcgaaatacaaagcggcggcggggaagcaaaccattctgctggattattcacgcgcagaagtgaacgagatgcagatcctcaaacaagctgatgtggtgatgctcaattacatgctgccggagcagttctcagcggcatcgtgtcttgccaatctgcaattttatgaaccgcgcactattcacgactcgtcattaagtaaagcaatccacggcattgttgccgcacgctgtggcctgctgacccaaagttatcagttctggcgcgaggggactgaaatcgatcttggtgctgatccacatagctgtgatgacggtatccacgctgccgcaactggcgctatctggctgggggcgattcagggttttgccggggtgagcgtgcgtgacggtgaattacatctcaatccggcgttacctgagcagtggcaacagttgtctttccctctgttctggcagggctgcgaattacaggtcactctcgacgcgcagcgtattgcgattcgaacttctgcgcccgtttcactgcgcttgaacggtcagcttatttacgtcgctgaagaatctgttttctgtttgggggattttattttgcccttcaatgggaccgctaccacgcatcaggagggtgaatgaaactgcaaggggtaattttcgatctggatggagtaatcacagatagcgcacatctgcatttccaggcgtggcagcagattgccgctgaaattggcatcagcattgatgcgcagtttaacgaattcctaaaagggatcagccgcgatgagtccctgcggcgaattctgcagcacgggggtaaagagggcgattttaacccacaggaacgggcgcaactggcgtatcgcaaaaatctgctttacgtccactcactgcgcgaactgacggttaatgctgtgctgcctggcattcacaatttgctggtagatctccgagcacagcagattccggttgggctggcttctgtctccctgaatgcgccgacgattttagcagcgctggagctgcgtgagtttttcaccttctgcgcggacgcttcccaacttaaaaactcgaaaccggacccggaaatctttctcgccgcctgtgccggactgggcgtgccgccgcaggcatgtatcggcattgaagatgcgcaggcgggcattgacgccattaacgccagcggtatgcgctcggtggggatcggcgcaggcttaaccggggcgcaattattgttgccctcaacggaatcactcacctggccgcggttatcggccttctggcaaaacgtatagcaaaggaatcaacatggctcagctttcgttacaacatattcaaaagatctacgataaccaggtgcatgtggtgaaggacttcaacctggaaattgccgataaagagttcatcgtatttgtcggcccgtcgggctgcggtaaatcgaccaccctgcgtatgattgccgggcttgaggagatcagcggcggtgatctgttgatcgacggcaaacgaatgaatgacgttccagccaaagcacgcaatatcgcgatggtgttccagaactacgcgctgtatccgcatatgacggtctacgacaacatggcgtttggcctgaagatgcaaaaaatcgccagagaggtgattgatgagcgggtgaactgggcggcgcaaattctcggcctgcgtgagtacctgaaacgcaagccgggcgcgctttccggcgggcaacgtcagcgagtggcgcttgggcgggcgattgtgcgcgaagcgggcgtgtttttaatggatgagccgctctctaacctggatgccaagctgcgcgtgcaaatgcgcgcagagatcagcaagctgcatcagaaactgaacaccaccatgatctacgtgacccacgatcagaccgaagcgatgaccatggcgacgcggattgtcattatgaaggatgggattgttcagcaggtcggtgcgccgaaaacggtttataaccaacctgcgaatatgtttgttgccggatttattggatcaccagcgatgaattttattcgcggcacgatcgatggcgataaattcgttacggaaacgcttaaattaaccatacccgaagagaaattagcggttctgaaaacacaggaaagtttgcataagcccatcgtaatgggaatacgcccggaagatattcatccggacgcgcaagaggaaaataacatttccgccaaaattagcgtggcggaattaaccggtgcggaatttatgctctacaccacggttggggggcacgagttagtggtccgtgctggtgcgttaaatgattatcatgcaggagaaaatatcactattcattttgatatgactaaatgtcatttctttgatgcagaaacggaaatagcaatttgctaaatacagggggaaggcattctcccaggataatacaaggaacaataatgaaaaagttattactctgtaccgcactggtgatgtgtgcgggaatggcctgcgcacaggccgaggaaaagaacgactggcactttaatatcggcgcgatgtacgaaatagaaaacgtcgagggttatggcgaagatatggatgggctggcggagccttctgtctattttaatgccgccaacgggccgtggagaatttctctggcctattatcaggaagggccggtagattatagcgcgggtaaacgtggaacgtggtttgatcgcccggagctggaggtacattatcagttcctcgaaagcgatgatttcagtttcggtctgactggtggtttccgtaattatggttatcactacgttgatgaaccgggtaaagacacggcgaatatgcagcgctggaaaattgcgccagactgggatgtgaaactgactgacgatttacgtttcaacggttggctgtcgatgtataaatttgccaacgatctgaatacgaccggttatgctgatacccgtgtcgaaacggaaacgggtctgcaatataccttcaacgaaacggttgccttgcgagtgaactattatctcgagcgcgctttcaatatggatgatagccgcaataacggtgagttttccacgcaagaaattcgcgcctatttgccgctgacgctcggcaaccactcggtgacgccgtatacgcgcattgggctggatcgctggagtaactgggactggcaggatgatattgaacgtgaaggccatgattttaaccgtgtgggtttattttacggttatgatttccagaatggtctttccgtttcgctggaatacgcgtttgagtggcaggatcacgacgaaggcgacagcgataaattccattatgcgggtgttggggtgaattactcgttctgataatgtgctaaattgccggatgcggggcgagcgccaaatccggcatatatttatttcaacgacatatgcgtagcaacggtaatattttgtggtgacggttttccggcaattagctggaataataactcgcagctttgttgacctaactcctgcgtcggaacatcgatgccgcctggtgcaggcgttaatataaacgacagcgtttcattactataacccaccaccgctaactgctgcggaatagcaatatttttctctgctgctgcacgataaatgctcattaatttcaggctgtcagtggcaaatacggcttctggcaacggcgactggcttaataattgccgtgcggcttgcaaggctgtttcatgggtataaccgccgtcaacaatccattcatcacgcactgcaatattatgcgcagccaggctttgcttataaccatttacccgatccactgaaacatgtacatcaagcggcgcatgcaggcaggctatattcttatgcccgctttcaattaacgcattggtcagcgcaatactgtcgccataattatcggtatcgacggaataaacatggctgtattgaccttcaactttaccgatcaccaccaccgggatctcgtatttgtcgagttgtgcaaagaaggattcatcggcaggcgaacttagcataataatgcctttaatcattttctgcttaattttgctttcgcatttttgcagatcttctgccggattgtgcgacgtttgtaatatcacgtcgaaaccttcttcttctgctttggcggtgatggcatgcaaaacttccgagaaaaatggattacccgccgtagttttggtcgaacgggtagaaatcaccataatggcatcaaaacccgaagaggtcagcgcgcgggccagcttgtttggttgatactgtaattcttcaatggcccgtaacactttttcgcgcgcttccggggagatattggtttgcttattcagcacgcgtgatacggtggattttgatacgcctgcaaccctggcaatatcataaatagtaggggacataggtcaggaactccgtccgaacgtgaatgctgcacatcttatggagttcgtccgtcgatgacaacacgggtagttgataatcaatggcctggcccccacattcatatccttacgaacgatttttttttctggtcttcagagcagcacaggacagcaatgaagcgacttaaaaatgaactcaatgcgctggtgaatcggggtgtcgacagacatctgcgcctcgctgtaaccggacttagccgcagcggcaaaacagcgtttatcaccgcgatggttaatcagttgctcaatattcatgccggagcacgtttgccgcttttaagtgcggtgcgtgaagagcgcctgctgggcgtaaaacgcattcctcagcgtgactttggcattccgcgcttcacctatgatgaaggactggcgcagttatatggcgatcctcccgcctggccgacgccaacgcgcggcgtcagcgaaattcgcctggcgctacgctataaatcgaacgattcgctgctgcgccactttaaggatacctccacgctgtatctggagattgtggattaccccggcgaatggttgctcgacctgccgatgctggcgcaggactatttaagctggtcgcgccagatgacgggcttactcaatggtcagcgcggcgaatggtcggcgaaatggcgaatgatgtgcgaagggctggacccgctagcgcctgccgacgaaaaccgactggcagacattgccgccgcgtggaccgattatctccaccactgcaaacagcaggggcagcactttattcagccaggacgctttgttttgcctggcgatatggcaggagcgcccgcgctgcaattcttcccatggccagatgtcgatgcctggggcgagtctaaactggcgcaggccgataaacacaccaacgccggaatgttgcgcgagcgttttaattattactgcgagaaggtggtgaaaggattctataaaaatcacttcctgcgttttgaccgccagattgtgctggtggactgcctgcaaccgctcaacagtggaccacaggcatttaatgatatgcgtctggcgctgacgcagctgatgcaaagtttccactacgggcagcgtaccctgttccggcgtttgttttcgccggttatcgataagctattgtttgctgccactaaagcggaccatgtgaccatcgatcagcacgctaatatggtttcattgctgcaacaactgattcaggatgcctggcaaaatgcggcgttcgaagggatcagtatggactgcctggggctggcgtctgttcaggcgaccaccagcggaattattgatgttaacggtgagaaaatcccggcgctgcgcggtaatcgactcagcgatggcgcaccgctcactgtttatcctggcgaagttcccgcacgtttgccaggtcaggcgttctgggataagcaaggcttccagtttgaggcgtttcgtccgcaggtgatggatgtcgacaaaccgctaccgcatattcgtcttgatgctgcgctggaatttttaataggagataaattgcgatgaccgaaccgttaaaaccacgtattgatttcgacggtccactggaggtcgatcagaatccaaaattcagggcgcagcagacctttgacgaaaatcaggcgcaaaattttgccccagccacgctcgatgaagcgcaggaagaagaggggcaagttgaagcggtgatggacgcagcgttgcgtccgaaacgcagcctgtggcgcaaaatggtgatgggcgggctggctctgtttggcgcaagcgttgtcgggcagggcgtgcagtggacaatgaacgcctggcaaacccaggactgggtggcgctgggtggatgtgccgctggggcattgattatcggcgctggcgtaggttctgtggtaacagagtggcggcgcttatggcgcttgcgacagcgcgcccatgaacgcgacgaagcgcgcgatttgttgcacagtcacggcacgggtaaaggccgtgcattctgcgaaaaactggcgcagcaggcgggtattgatcagtcacatccggcgctgcagcgctggtatgcctcaatccatgaaacgcagaacgatcgtgaagtggtcagcctgtatgctcacctggtccagccagttttagatgcccaggcgcggcgcgaaatcagccgttcggcagcggaatcaacgttaatgattgccgttagcccactggcgctggtggatatggcgtttatcgcctggcgcaatctgcgtttgattaatcgcatcgccacgctgtatggcattgaactgggatattacagccgtttgcgcctgtttaagctggtattgctgaatattgcttttgccggagccagcgaactggtgcgcgaagtggggatggactggatgtcgcaagatctcgctgcgcgtttgtctacccgggcagctcaggggattggtgctggacttctgacggcacgactggggattaaagctatggagctttgccgcccgctgccgtggattgacgatgacaaacctcgcctcggggatttccgtcgtcagcttatcggtcaggtgaaagagacgctgcaaaaaggcaaaacgcccagcgaaaaataatgcaatatcgggtgctgaccggatatctttacgccgaagtgcccgtttttccgtctttgtgtcaatgattgttgacagaaaccttcctgctatccaaatagtgtcatatcatcatattaattgttcttttttcaggtgaaggttcccatgcgtctggaagtcttttgtgaagaccgactcggtctgacccgcgaattactcgatctactcgtgctaagaggcattgatttacgcggtattgagattgaccccattgggcgaatctacctcaattttgctgaactggagtttgagagtttcagcactctgatggccgaaatacgccgtattgcaggtgttaccgatgtgcgtactgtcccgtggatgccttccgaacgtgagcatctggcgttgagcgcgttactggaggcgttgcctgaacctgtgctctctgtcgatatgaaaagcaaagtggatatggcgaacccggcgagctgtcagctttttgggcaaaaattggatcgcctgcgcaaccataccgccgcgcaattgattaacggctttaattttttacgctggctggaaagcgaaccgcaagattcgcataacgagcatgtcgttattaatgggcagaatttcctgatggagattacgcctgtttatcttcaggatgaaaatgatcaacacgtcctgaccggtgcggtggtgatgctgcgatcaacgattcgtatgggccgtcagttgcaaaatgtcgccgcccaggatgtcagcgccttcagtcaaattgtcgctgtcagcccgaaaatgaagcatgttgtcgaacaggcgcagaaactggcgatgctaagcgcgccgctgctgattacgggtgataccggcaccggaaaagatctctttgcgtatgcctgtcatcaggcaagccccagagcgagcaaaccttacctggcgctgaactgtgcgtctataccggaagatgcggtcgagagtgaactgtttggtcatgctccggaagggaagaaagggttctttgagcaggcgaacggtggttcggtgctgttggatgaaataggtgagatgtcaccacggatgcaggcgaaattactgcgtttccttaatgatggcaccttccgtcgggttggcgaagaccatgaggtgcatgtcgatgtgcgggtgatttgtgctacgcagaagaatctggtcgaactggtgcaaaaaggcgtgttccgtgaagatctctattatcgtctgaacgtgttgacgctcaatctgccgccgctacgtgactgtccgcaggacatcatgccgttaaccgagctgttcgtcgcccgctttgccgacgagcagggcgtgccgcgtccgaaactggccgctgatctgaatactgtacttacgcgttatgcgtggccgggaaatgtgcggcagttaaagaacgctatctatcgcgcactgacacaactggacggttatgagctgcgtccacaggatattttgttgccggattatgacgccgcaacggtagccgtgggcgaagatgcgatggaaggttcgctggacgaaatcaccagccgttttgaacgctcggtattaacccagctttatcgcaattatcccagcacgcgcaaactggcaaaacgtctcggcgtttcacataccgcgattgccaataagttgcgggaatatggtctgagtcagaagaagaacgaagagtaagcgtgaatatgcctgatggtgcaacaccatcaggcatattaacttatgctttcagtacagccagagctgcttcgtaatccggctcggtggtgatttcatccaccagctggctgaaaatcacattgtcattttcatcaataaccacaacggcacgcgctgccagacctttcagtgggccatcagcaattgccacaccgtaggcttgcaggaattcagcgttacggaaagtggagagggtgataacgttgctcagaccttctgcgccgcagaaacgagactgggcgaacggcagatcggcagagatacacagcacaacggtgttgtcgatctcggttgccagttggttaaacttacgtactgatgcggcgcaaacaccggtatcaatactcgggaaaatgttcagcactttgcgtttacccgcaaactgaccgagggtgacgtcagacagatcttttgccacgagagtaaaagtctgcgctttgctacccgcctgcgggatggaattggcgactgtaaccgggttgccctggaaatgaacggtttgtgacatgattatctttcctgtttacatatagttaacgtcacacctagtttatgctaactgtcaataacacagcaaacgctatttgcgcttaatccgcagaccaccgcgacaacaaggagtaaagatgagaaccgttaaggtatttgaggaggcctggcccttacataccccgtttgtgattgctcggggaagtcgcagtgaagtgcgcgtggtggtggttgaactggaagaagaaggtattaaaggcaccggcgaatgcacgccgtatccgcgttatggggaaagtgatgcctcggtaatggcgcaaattatgagcgtcgtgccgcaattagagaaagggctgacacgggaggagttgcaaaaaatcctccctgccggcgcagcacgtaatgcgctggattgtgcattgtgggatctggcggcgcgaaaacagcagcaatcgctggctgatttgatcggcataacgcttcccgagacagtcaccacggcacagacgatagtcatcggtacgcctgatcagatggccaatagtgcatcaacactctggcaggcaggcgcgaaattactgaaagtgaagctggataaccatcttatcagtgagcggatggtggcaattcgcacagctgtgcccgatgcgacgctgatcgttgatgcaaatgaatcctggcgtgcagaagggttggcggcgcgttgccagctattggcagatttaggcgttgcgatgcttgaacaaccgcttcctgcgcaggacgatgcggcgctggagaattttattcatccgttaccgatttgtgctgatgaaagttgtcatactcgtagcaatctgaaggcgctgaaagggcgctatgagatggttaacattaagcttgataaaaccggtggtctgacggaagcgctggcgctggcgactgaagcgcgtgcacaaggttttcgtctgatgctgggctgcatgttgtgtacctctcgtgccattagcgccgctttaccgctggtgccgcaggtcagtttcgccgatcttgacggaccgacctggctggcggtagatgtggaaccggcgcttcagttcacgacgggcgaattgcatctttaggatgccagcgcagcaagtttgccatcgcaaagagatatttttcgctggcttcgtcggaggagatgggtggaaactctgcggtgatgcaatgcaagttgagatctgcacaccaactgccgaaagagccaggcgtttcataaccgacgctggttaccagaggcaattcaaacgcctgggccagccattcacctaattcgctgtgtctgggatcttcaatacaggccagcggatcgtggaatgagaccacccaggcaggttgaatgcggtgtataagctggcacagcgcctgggtttcaggttcggagccaggtttgtcacctgtcagtaaaacgacatcacgttcttcagcggcgctgttccagcgataaactgtttcaccttccttccagttcgctgccggaaagtttcggtttaaatccacaccattagcattggcccgtaaccctaactggcagccgtcaggattcacacacagcaccacatgatggcggcgcaaagaaggtgtcaaagtccgcagagcacaggagagcgtgacgatcgaagagttttcatcaccgtgagtgccagccagaatcaaaccactttcgtgactggctgcaggggccggaaaccagattaacggcgcgcccaataatgaacgtccgtaatgttctgttccgggcggaaatgcgccgcgttcggcgcgtgggcgagttacggtcatgatcgtctctggttcaggaagtattacaggcagtgttgtgcaaattttgcggattatcaaatccttttcttcaacgctatgtcatcgatcttgtatcacttttttgccggaagttgtttgtattttcattgatgtgcagatattagaattgtcgtaatgttatatacatggcgtattttattcttactggttctacacatgttaatcgcatctgattgatcagttcaccttaataagtttaataaatcgtactgcacatagtacagtacgatggtagctatataattgatttacatgaagaagggcttatcaccatcagtcccgggttgattgatgcctatattctcaccaatgtgtttctcaggtttatcgatgatatctgtgattaatgctgcgacactcttacgtgatacgatcgtacctttgaatggttcattgcgtgaggtaagctcataatcaataatatcttcatcagtcagccaggcagggcgaagaattgtatattccagtccagaagcctcaattgcatccgcagccctgcggaatggttttaggggttcaccaataactgcattattccattcgccaaattttcctggaacttcatcataaataccgagggaaagaacaaagatcagacgtttaacatcacaggctttcatcgcagcgatcactgaatttgcctgaatatctaaatcttcccccgtaaggttggcatacacaacatcctgtccctgcatggcctgcttcaatgctgcatgattcagtacatcccccataataatcttgctattagttggatagggtttgtggatttttgctggctgacgggcaaataaagtttgtttaatggtttgtttatctgccagttgattaatcacatggcgggctatctgaccgccagcaccaagaatcagtacatttttcatgaaacttttcccagattattggcagcaatatgccaggccatatcactattacggatttgaatatgtttcattacagagtttcctcaaagaacggagctaatactgaaattgcttcagccatatagactttgccatcataaagatccatatggtttgcgccttcaacaatgtgatagcgtttatcctggcttgatgctcgatcgtacaggtcgtcactcatccatttgctcccagcctggctgcccgccacaatctgtatcggctgagtcaggtacacttccgccatatggtaagcatcataggtaataatctggttaaggctgcgcaaagtagcgtaacccggtgctgttggatactgcgcgcgaggggtgtggtaatattcctaggcctgacgcagttcttcgttcggcgcatcggactccttcattggtgccagtggcatagtggcgtattctccgctgctaatatcgctggttcgggcgtttgaacccgcgtcaacgtatggtagggcatcaatagatttcacattgttttcccaaccattacggaacatcgaaccaatattgaccgcactaacagtaccgatggccttgatgcggcgatcctgaattgcagcattggctgtatatcctgcaccggcacaaattcccatcgcaccaattcgggtattgtcgacataagaaagcgttgtcaggtaatcaatcacggcactgacgtcttcagtacgaatgtatgggttttctaactgacgcggctcgccgccgctttcaccttgataagatgcgtcataagcaatagtgacaaatccctttccgccagtttttcggcataggttccggccgtttgctctttaacgcccccacctgggtgagataccacaattgccggatactgacgggtttcatcaaattttggagggaaatagatcactgcagacaaagagatggttggattattgctgttagtgaagctgactttattattcatcattccgttcctcatggagttgtcggttcgttttaacggttggtgatatcactatagatattgatcattaagttgattagacccaaaatcatgattagacctatcatttaaatgattaatagattgtatggagatactgaatgaagcgtgaagaaatcgctgatctgatggcgtttgtcgttgttgcagaggagcgtagcttcactcgcgcagcagcccgcctgagcatggcgcagtcagctttaagccagatagtgcgccgtatagaagaacgattgggattgcggcttctgacgcgaaccacgcgcagcgttgtacccactgaagcgggcgagcatcttttgtctgttcttggccctatgttgcatgacatagattctgccctgacatccctgagcgatctgcagaaccgcccatccgggacaatacgtattactactgtagaacatgcagcaaaaacgatattgttaccagctatgcgcacattcctgaaatcgcatcctgaaattgatattcagcttaccattgattatggtttgaccgatgtcgtttctgaacgttttgatgcaggcgtccgtctgggtggggagatggataaagatatgatcgccattcgaatcgggccagacataccaatggctattgttggctcaccggattatttttctcgtcgaagtgctccaacgtcagtgtcacaattaatagatcatcaggcaattaatttgtatcttcccacatcgggtacagcaaatcgctggagattaatacgcggtggacgtgaagttcgtgttcgcatggaaggtcagcttttactgaatacgatagacctgatcattgatgctgcaattgatgggcatggattggcgtatctaccttatgatcaggttgagcgggctattaaagaaaaaaaactgatacgtgttttggataaattcacaccagatttacccggttatcacctgtactatccacaccgtcgacatgctggctcggcattctcattatttatagataggctgaagtataaaggtgctgtttagcactacttgctgatacattaatttaattcttctcttaacgtattctcagttcctttcaacgttttggttattttttattcttcgcacaatggcgacagatgctgattatgataccgaaaacgggtttgaacgtgcgaagcccgaacgtagtgttcggagttctatgtgctttaccgcattttggagactattatttacactaaatctgatttgatatattgatacttaaaacatttgatgcttcctttgtcacttttttgatggaagttgtttgcatttctttaaggcgaaacaaataattacgcatcaattttaatgtcggttagagggaaacttatgaagcactctgtttcagtcacgtgttgtgcgctgttggtcagcagcatttctctttcgtatgctgctgaagttccgagcggcacagtactggcagagaagcaggagctggtgcgccacattaaagatgagccagcgtcgctggatcccgctaaagccgtgggcctgccggagattcaggtcattcgcgatctgtttgaaggactggtgaatcagaacgagaaaggggagattgtccccggcgttgcgactcagtggaaaagtaatgacaaccgtatctggacttttaccctgcgcgataacgcaaaatgggcggatggcacaccggtaacggcgcaagattttgtctacagctggcaacgtctggtggacccgaaaacgctatcgccatttgcatggtttgccgcgctggcgggaatcaacaacgcacaggcgattattgatggtaaagccgcgcctgaccagcttggcgtcaccgcagttgatgcccatactttgaaaatccagcttgataaaccattgccgtggtttgtgaatttaaccgctaactttgccttcttcccggtgcaaaaagccaacgtagaaagcagtaaagagtggacgaaacccggaaatctgatcggcaatggcgcttatgttcttaaagagcgcgtagtcaatgaaaaactggtcgtggtgccgaatacccattattgggataacgccaaaacggtactgcaaaaagtgaccttcctgccaattaatcaggaatccgcagccactaagcgttttctcgcgggggatattgatatcaccgaatccttcccgaaaaatatgtatcagaagctgttgaaggatattccggggcaggtttatacgccgccgcagctcgggacctattattatgcgtttaacacgcaaaaagggccgacggcagatcagcgcgttcgcctggcattaagtatgacgatagatcgccgcctgatgaccgaaaaagtgttggggacgggcgaaaagccagcgtggcattttacaccagatgttaccgcgggatttacgccggaaccttcgccgtttgaacaaatgagtcaggaagaactgaatgcgcaggcaaaaactttgttgagcgccgctggttatggtccgcaaaaaccgctgaagctgacgcttttgtataacacttcagaaaaccatcaaaaaattgcgattgctgtagcatcgatgtggaaaaagaacctgggcgtagatgttaaattgcaaaaccaggaatggaaaacctatatcgatagccgtaataccggcaattttgatgttatccgcgcctcgtgggtaggggattataatgaaccctccactttcctgacattattaacgtcaacgcattccgggaatatttcacgctttaacaatccggcatatgacaaagttctggcccaggcatcgacggaaaataccgttaaagcgcgtaatgccgattacaacgcggcagaaaaaatcctcatggagcaagcaccgattgcaccaatttatcaatataccaatggacgattaatcaagccgtggctgaaaggttatcccattaataaccctgaagatgtggcgtacagtcggactatgtatattgtgaagcattaatgtgatgggaactggcgttacccttgtggataacgccagtgatgtctgatttagcgaccctggtccggcggtgtaatgttatccatatacagcgtctggctggggaaggcaaagtccgcgccgtgtgactgtacaatatcgataatcttcaaataaacgtcttgctgtgcggcaagccactcagcccataccgtggttttggtaaagcaataaaccataatatttaatgacgaatcagcaaactggttgaaataaaccagtaaggtttgtcgctggtcgatggccgggtgatttttcagcatctcacgtacggcttcgacaataacgcccacttttgccgcatcctcataacgtaaaccaatggtcgtggtaatgcgccggttggtcattcgtccaggattttctacgctgatcgacgaaaacagcgagttcggtacgtacaatggacgattatcaaaggtcttaattttggtaattcgccagccaatttccgttactgtaccttcgatatttctgtccggtgaacggatccagtcgccaatactgaaaggacggtcgaaatagagcataatcccggaaaagaagttactcagaatatctttaccggccataccgacagccagaccaccaataccaccaaaggtcaacaagccagaaaggctcatgccgaaatgttcgccataaagcagaacaagcaccacaataatggtgattttgataatgcgcgacatgatccgcgcactggtgatatcacgaccttttttaatctgctgtttttcaaactgattaatcagcagaaatagcttaatcgtcagaataaccgcaatcagggacgtacagataaaatcgataacgcctggggtgataaatttgagtttatagttttctataacatagttaatgatgctaccaacagcactaataattatggtgtagattaaaaattgcaccgcatggaataaaaatccttttcttttacgatctccacggcgaaaccaaaagctcatcagaatcaatgctgcgcagctaccgaaaataatgaccagattaagcgcattatttgtaaacagttcagcgatcattgttttatcaggctcctccagataattgtcgtcatgccggaaacccctggcgggactattttaccgcgacaattcattcagatcatcaatagtcagggaaggaagtagcaacattagctaactaatcaatgcgttgattgtaaatccagctaagaggtgagattttcagagcagacaacggtgaaatgtcatggtattgttacgtttaggtaacaagaaatttatctgcacaaggattacatcatgattatggcgaaactgaagtcagcgaaagggaagaaatttctctttggtttgttggcggttttcattattgcggcgtcggttgtgactcgcgcgaccatcggcggcgttatagaacagtacaatattccgctgtctgagtggacgacatcaatgtatgtgattcagtcatcgatgatttttgtttatagcctggtctttactgtgttgctggcaatcccgttgggaatttatttccttggcggcgaagagcagtaagtaaaaaataggcccgataactcgggccttgtcagttattgaagagtcgttaatcgtcttcttcgtcatccagttcaacgggtgtctgatactggtcaggtttaatgaccagcaggtcgcagcgaagatgatcaatcacctgttccgccgtgttgccaaggaatgctgctgaaataccggtgcgtccgaccgtgcccagaaccacaattcccgcctgtaagtgctccgccaaatcaggaatcacctcttcgggcagacctttttctacgtgcgtcatgttttcattaatgccgaatttctgccgcagagctttcattgccagcaaatgctgcccacgaatggcatcgttataaacgctcgggtcaaattccggcagttcaatcgcgatattaattggcgttaccggataagcgccaaccagatgaacttcggtatggttgacttgttctgccagttcgatcgtctctttgaccagtttttcattgagcgcattatggtacggctcttcactggcgagattcaccgccaccagcgccttacccccttccggccacggctggtctttcaccatccacaccgggcttgggcatttgcgtaacagatgccagtccgttggcgtaaaaatcaccgcttccagacggtcatgttggtgcgccatttttagcaccaaatcgtgcccgccgctgatcacttcctgaatgatggcttcgaaaggacggttatgccagaccactttaatttcaatgggaacgccagcattgagataatattttgcctgctcgtggatccaggctgtacgctggctgatgacgccctgacgcatagcggtacgttcgtccggagagagcagggtggtcatttcgtatgagaagtcatagatcggcaaaaaggctttaattttgccaccaatccgttgatgtaaataaacagctcgccgcaatgctggttggtcgtcctggttaggatcgataacaacgagcatgttctgatacatagccatacagggtctccttacaacaactgtcaacgcagtttgtaattaaaagattaacccatatctggtgaatgaaacagtgatgaaccttctgtcagatcaataaatcagaaaaatttaatgatatgacagaaggatagtgagttatgcggaagaatcaggcaacgttacgcgtgtgaccagcaagctgggccagcgcatcgttattttcgatagtgatgtatttacctttgactgccagcataccgcttttctggaagcgacccagcagacggctgatggtttcaaccgtcaggcccagatagttaccgatatcaccacgagtcatcgtcaggcggaattcacgaggggagaagccgcgttgggcaaaacgacgggataggttgtagatgaatgcagccagacgttcctcggcatttttcttcgacaacagcaggatcatgtcctgatcgcctttgatttcaccgctcatcagacgcatcatctgctgacgcagattcggcattttaccagacaaatcgtccagcgtttcgaacgggatttcacataccatcgaggtttccagcgcctgcgcgaaactcgggtgatgaccgctgccgatggcatcaaatcccaccagatcgcctgctaaatggaaaccagtgatttgctcgtcgccttgctcagtgatggtataacttttaatcgtaccggagcggatggcataaagcgattttagttcatctccagccttaaacagcgtctggcctttctgaataggcttcttccgctcaatgatattatcaagctgatcaagctcatgttcgttgagtgtgaacgggatgcaaagctggctgatgctgcaatcctggcaatggatagcacaaccgccagactgaatgcgccgtataattcgcttttccgggatcataggtctgctcaagccgtaattgatatttgtcaattttaacatctttttagggagcaagtaagtctaagcaaaccttaacagcagagaattccgatattagatgtaaatatatgtctatctatttgaaaacccttaagttgttaagggtgactttacataaaagtgtgaacaagctggcacaaattgtttaatgtttacagcaaaagataaccttcgtggcgcaataaccactcttttcgctgaactccgcctgcatatccggtcatggtgccgtttcggccaataacccgatggcaaggtacgacgatgctgatgggattcgatccgtttgccgcacctacggcacgcgccgcaccggggcggcccaattgttcagccagttggccgtaatgcattacctgcccgcaggggattgtgcgtaatgttttccagacttcgcgctgaaatggcgtcccccccgtggcagtgggaagcgtatcaataatgctaagattaccggcaaaatattcacgaagcttgtcacttaaaccacctgggttggtggcagaaatacgttcatagccttctttgcggtaatggatgtccagcagctgcaccatgcgttcgctgtactcttcccattcaaccgcccgcaggcgaaattgctcatcgcaaatcacccacagtggacccagtggcgtggcaattttttcttcaagtaatctcagcatccgttctctcttaagacaaacgtgggtaaatacccggacctatcggcaagccaacaagataccacgccagcaacatcagcagccataccaccaaaaagattaatactaacaaaaagtaagtaccaggtttcgcgtctggtttgtcgcagtatttaagcataaagcgattttttgatttttctgcctgaagaaatgagggcaagccatcacatggatcgagggtgggataattccagtcagcgaaattttaccgtaggctatctgttatttgattctgtggcgtgatagccgccagacaccactgatctcgtcactcattccccaatcccggcgagaatgtggttatttacagagctaaaaaatgaataaaaaaatagagcctgtcgacatccgccagactctacagtacacacagcagtgcatcctcgtcttaaatccggcctggggtcctggtgaccggtgacagtgttataacggttttacccatccgttgccaattttcttcagtgacagatttcacgaaaatataagttaaatcatttgtcttgtgattgcataatcatgcatcgttaatcgacgagtaaatttaccgggtgagtagcccgttcgacgcttaaacatattgccgaacgattcagctgaggcatagcccagacgatgggcaattttggtcaacgaatatccatcatcaagaagcgtcactgcagaaataacgtgcatttgctgaacccagtggcgaaatgttaatcccgtctctttaacaaataagcgcatgagtgtacggctactgacgttaattttatccgctagattatccagtgttggcagatacccttggttgtttagcaaattctcacaaagctgctgtagccgctcatcatttggccaagggagttcaagtgacattttcacccccatttttatttcctgaagtatcagtgtctcgagggctgaaaaacgtaactgttgtttatctgtggtactttgcgacggtggaagttggttaattgcaattagtaattcccttaacaggggtgaaatacccgtcatgaagcaaacttttcccagcgtttcactttccgcttctgaaaccagtacggtttttaaaagtacgttgcctgtcgcaacaaacttatgcggcatttgtgggggcagccaaagagcgctgctggcatgcactagccagacgctttctccagcccatatacgaacgactccttcagccgggtaaagcaactgggcatagagatgtttatgccagggaactgtgcctccattcagatgttccgaatccagtccgataatgtgatgccctggtgatgctttgggttgcagtgtgattgtcatttacagtaggtattttgtcagaaatcatcaaataagccatgttaaattttaaatatgacgtatgcaagtttccggatatatacggtgtaaagagtgatgataatttctaaaaaacagcttattggggtggtagcgatcggtattcttttggctggcgttgtcttttttatctggtgggtaagcaaaggaagatttatacagacgacggatgatgcttacattggtggtaatatcaccacggtggcaagtaaagtttctggttatatttctgctatagaggtgcgcgataatcagagtgtaaaaaaaggcgatattatcctgcgtctcgatgatcgggattatcgtgcaaatgtcgccaggcttgaggcaaaaataaaaagtagcaaagccaatctcgaaagcattcaagccactattgcgatgcagcagtcgataattcaaagtgccagtgaaacatggcaggcagtaaaacatgaggagcaaaagcgcctgcgagatactgaacgttatgaaaaactcgcacaatcagcggcaatatcgcaacaaattattgataacgccaggtttgactaccagcaggtcgcagcaaaggagcgcaaagccgcgaacgatttcctggtggagaagcaacggctggcagttttatctgctcaggaagaaaacgtacgtacaagtatcgaagaagttcaggccgctttgactcaggcactactggatctggaatatacccttgttcgtgcgccgattgatggcattgtcgcaaaccgcagcgcccatacaggcagttgggtggaaggcggcacatcgttagtttcactagtaccagtcagtgagttgtgggttgatgcaaattataaagaaaaccaaatagcgggaatgaagccaggaatgaaggctgagatccgtgctgatattctcaaaggggaagtgtttcacggtcacattgaaagcctttccccagcgacaggagccagtttcagcttgattccgatagaaaatgccactggcaatttcaccaaaattgttcagcgtgtcccggtacggattgcatttgacgacgcaaaggaattaaagcaacttcttcgccccggactgtccgtcaccgtcagtgttgatgagagatgatgtctatgcgtaaacatattgctttcgccagtatgtgtatgggattatttattgctcagcttgatattcaaattgtatcgtcatccctaaatgaaataggtggtggtctgtccgcaggtaaagacgaaatggcctggcttcagactagctatttaattgctgagattattgttattccgctctctgggtggctgtcacgggtattttccactcgttggctttttactctatccgcgggaatatttactttaatgagtatcgcgtgtggacttgcatggaatattcagatcatgattttgtttcgtgctttacagggagctgctggcgcatccatgatccctttagttttcacgacggcgtttatttattaccagggtaaagagttggggttggctgctgcggtagtcagtgcgctggcctcactgtcaccgacgctagggccaactctggggggctggatcactgataacctcgactggcgatggctattttatatcaatatattacctggcatatatttagttttgagtattccttttctggttaattttgataaacctgatctctctttactgaaagttgctgattatccgagtattatcctgttggccatgacactgggatgtctggaatatacccttgaagaaggagcgcgctggggatggctggatgataatactattttgctgacatcagttctggcattggtaagttttattttatttgctgcgcgtacacttacaatatccaatccgataatggatcttaatgcttttaaggataaaaatttcacactgggatgttttttctctttttctggaggggttggaatattctctactgtatatttaatacctgtgtttttggggcaggttcgcggattaaatgccgaagagataggttttgccgtttgcacaacaggtatgttccagttattttctgttcccttttatttctggttaagtaaaaaaataaatctgcgatggctgttgatggcggggctgggtggatttgtgttttcaatgtatctttttacccctataacccacgaatggggatggcaggagttactgtttccacaggcaattagagggatttcgcagcagtttgcgatggcccccatcgtaacattaacgctggggggaattccaaaagaacggctgaagttagcatctggtgtatttaatttaacacgtaatcttgggggcgcaattggtattgccctgtgtggctctattctcaataatcgaactaattttcatttttcgagaatgagtgaaaaaatggtttctgttccccatacggtgaatgacttcatttccagaagtgctttgttttttaatcgcagtggaagtgaccagacatcggaaatactggcttcaaccaaattattgagtcaattgatgctgagggaggcgcaaactatggcattttcggatacctttctgctaatcagtggtctgttatttatcgcatttttgttggttcctgctatgaataaatcatcctgatcggagcctgtgctgaattaaactcgggctaaactgttcgatactgctaacaggctagtataaaatgccccgcctgcgcagatactcacaggtatgaagtagagtattgtttcaatctgtgaagggaacgatgcagtaagtatgaacaattaacccgtctgaatcacgacgtgtgaaggtgcataggaggttacatgaaccttgacgacaaatcgctgtttcttgacgccatggaagatgtccagccgctgaaacgtgctacagatgtccactggcatccaacgcgtaaccaacgtgcgccgcagcgtatcgacacgctgcaacttgataatttcctcaccactggatttctcgacatcatcccgctaagtcagccgctggagtttcggcgggaaggtttgcaacatggggtgctggataagctgcgcagtggtaaatatccgcaacaggcgagcctgaatcttttgcgccagccggtggaagagtgccgcaaaatgatgttcagtttcattcaacaagccctggcggatggtttgcgtaacgtgctgattattcatggcaaaggacgggatgataaatcgcatgccaatattgtccgcagctatgtggcgcgctggctgaccgaatttgatgatgttcaggcatattgcactgcgctaccgcatcatggcggcagcggggcgtgttacgtcgcactacgtaaaacagcgcaggcgaagcaagaaaactgggagtgccacgctaagcgcagtcgttgatcacgagacgcatccgtggcttatgccgccagcacgcggttgcgtccatcatttttcgctcgatacaaagcatcatcaacgcgtttaaacagttcatcgatgctttcatttccttcgtgatgcgccacaccaatgctgacagtaaagcgtggtaagctcgaaatactcacttttgccacgcttacgcggatagtttcagccagcgaaagcgcggtatccagtggggttcttggtagcaataagacaaactcttcgcctccccaacgaaacaccaaatcgcctttgcgagcgcaactttcgagagtgcgggcaagggcgcataacacctcatcacctttagaatgcccatagagatcgttaatgtgtttaaaacgatcggtgtcgatgagcaacaagctgtaatcctgagcgatagcgaggtgctgcatttggcctggctcggtaatgtgataaaactgtcgccgattcagtaatccggtcatcgcatcatggtgggcagcatgttccagttgctcctccagccgtttttgctcagtaatatcatgcacaatacataacatgagcttgtcaccataaatttcaatcggcccggcataggtctgcacatgacgagtcgaaccatccgccagtttatgaacaaaattcaaaggtttatgaccaccgggtaaatgcgagatttcatgcatgataggcatgacgcgacgcccgagcatattaatttcccaggtatgtttctggcacatcgtttcatggttataaccatagaaattgagcgcggcgaggttagcatcgacgatttggccatctcgtgaggggtcaatcaacaacattggtgcagagttagtcagaaaaaagcgcgcataaaaaccttgttttttgcgctgataatttgccgagcgactggcttttaaacccagcgttgccggtgcttcgataccttcgaaaataatcaccggttctgtttctgtcagctctcgcaaaacaagccgacagcttaatgctgtttcctcttctttacgctgaacggtgaggatttcgataatatcgtgttgattttgcagatcggagaggtatttcggcagttctttttgtgaggagacggaatagggaccggttcgtagctgactaaacgtgaggtcttgcatcaacagtcgcgccgcgctgttggcataaattaactgttcctcaaagggcgaaacgatccagacaggactggtgagtaagtccagggtattgaagttgtgtgtaatcattgagatcccattatttttatcaatttttgttgctatccgatcgcaaaaaagccacgtcatatgatcagataattctgataatgatagacgctatttaacacttcacacggtttgtatacggaaaagcattttgctttttgtattcaatttagacagaattttattaatcatttcagggtaatggggtgatgagatgttgcgtaacagggccagaaggctagactacaaaataatgcgttgatgatggaggcactgtggaagcgattaagggatcggacgttaatgtcccggatgcagtatttgcctggatgctggatggtagaggcggcgttaaaccgctggaaaatacagatgtgattgatgaagcgcatccctgctggctccaccttaattatgtacaccatgatagcgcccaatggctggcgacaacaccgctgcttcccaataacgtacgtgatgcgctggcgggcgagagcacacggccccgagtcagccgtctcggtgaaggcacgctgattacattgcgctgtataaacggcagcaccgatgaacgccccgatcagctggtcgccatgcgtgtatacatggatgggcgattaattgtttcgacccgacaacgcaaagtgctggcgttggacgatgtggtgagcgatctggaagagggcactggtccgaccgattgcggggggtggctggtggatgtgtgcgatgcgttgaccgatcattccagcgaatttatcgagcagctgcacgataaaattatcgacctcgaagataatcttctcgatcagcaaattccaccgcgtggattcctggctctgctgcgcaaacaattaattgtgatgcgtcgctatatggcaccgcaacgtgatgtttatgctcgtcttgccagtgaacgtttgccgtggatgagcgatgaccaacgccgtcggatgcaggatattgccgatcgccttgggcgcggtcttgacgaaatcgacgcctgtatagcacggactggcgtgatggcggatgaaatcgctcaggtgatgcaggaaaatttagctcgtcgtacctatacaatgtcgttgatggcaatggtctttttacccagtacgtttctgacagggttatttggcgtcaaccttggtgggatccctggcggtggatggcaattcggattttcaattttttgtattctgttagttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttgcaggtgaatgcaacgtcaagcgatgggcgttgcgctccatattgtcttacttccttttttgaattactgcatagcacaattgattcgtacgacgccgactttgatgagtcggcttttttttgcctgttatttatcagcgtctaccctttaagagtccacccaatgaccggagggaaatatgacgacacttatttatttgcaaattcctgtccctgaaccgattcctggcgatcctgttccagtacctgatccgatccctcgcccgcaacccatgcctgacccaccacccgatgaagaaccgattaaattgtcgcatcgtgagcgtagatctgcgaggatacgcgcctgctgactttgcgtcgatgaccacgagaatagattgtgaccgctttttctaccctgaatgttttgcctcccgcccaactcacaaaccttaatgagttgggttatttaaccatgacgccggtgcaggccgccgcgcttccggcgatccttgccggaaaagatgttcgcgtgcaggcgaaaaccggcagcggcaaaacggcggcttttggcctcggcttgttacagcaaattgatgcgtcgctatttcaaacccaggctttagtgctgtgtcctacgcgtgaactggcggatcaggtggcaggtgaattgcgtcggctggcgcgttttctgtcaaataccaaaattttgacgttgtgcggtggtcaaccgttcggtatgcagcgtgattcgttacaacatgcgccgcatattatcgtggcaacgccgggccgtttgctggatcacctgcaaaaaggcactgtatcactggatgcgttgaatacgctggtgatggatgaggccgaccgcatgctggatatgggatttagtgacgccattgatgatgtcatccgttttgcgccagcatctcggcagacacttctgttttcggcaacctggccggaagccattgccgcaatcagcggaagagtgcaacgcgatcctttagcgattgaaattaactcaacagatgctctgccacctattgaacaacaattttatgagacatccagcaaaggcaaaattcctctgttgcaacggttattaagcttgcatcagccatcctcttgcgtggtgttttgcaataccaaaaaagattgccagtctgtctgcgacgcgctgaatgaagtagggcaaagtgcattgtcgttacacggcgatctggagcaacgcgatcgcgatcagaccctggtacgttttgctaacggtagcgcccgtgtactggtcgcgactgatgttgctgcgcgtggtctggatataaaatcgcttgagctggtggtgaactttgagctggcgtgggaccctgaagttcatgtacatcgcatcggtcgtacagctcgtgcaggaaatagcggtctggcgatcagtttctgtgccccggaagaagcacagcgggccaatatcatttctgacatgttgcagataaaacttaactggcaaacgctgccagcgaatagttccattgtgccgctggaagcagaaatggcaacgttgtgtatcgatggcgggaaaaaagccaaaatgcgcccgggtgatgtattaggtgcgctgacaggagacatcgggcttgatggcgcagatattggcaaaatcgccgtgcatccggcgcatgtttatgtcgcggtgcgtcaggctgttgctcataaagcatggaaacagttacagggcgggaagattaaaggaaaaacgtgccgggtgcggttattaaaataatgaaatgttgaattgcagggtgcaagagtaaacatcttcttaggcattgccggatgcgacgctggccgcgtcttatccggcctccataagagtagcccgatacgcttgcgtatcgggcgctatcctggttatttcacttcaaccacattcagccgtaactcatccaactgattttcatcttcttctggctgccagcccgctggttgtagtgggatctcttcgcgatcaaacgccagatcacccccgttaaccacttcagaaccgtgggtaatgcctttgaaatcgaacaggttggtatcgcacagatgcgacggcaccacattctgcatcgcgctgaacatcgtctcgatacgccccggataacgtttatcccagtcacgcaacatgtcagcaattacctgacgttgcaggttaggctgagaaccgcacaggttgcacggaataatcgggaacgcttttgcatcggcaaagcgctgaatatctttctcgcggcagtaggccagcggacgaatcacgatatgtttgccatcatcgctcatcagtttcggaggcatacctttcatcttgccaccgtagaacatatttaagaacagcgtttgcaggatatcgtcacgatggtgacccagcgcgatcttcgtcgcccccagttccgttgcggtgcgataaaggataccgcgacgaagacgagaacacagtgagcaagtggttttgccctccggaatcttctctttcacgataccgtaagtgttctcttcaacaatcttgtactcaacgcccagcgtttcaagatactcgggcagaacgtgttccgggaagcccggttgcttttgatcgaggttaacagccaccaacgaaaaattgattggcgcgctttgctgcaaattgcgcagaatttccagcatggtatagctgtctttacccccggagaggcaaaccatgatgcgatcgccttcttcaatcatattgaagtcagcaatggcttcgcccacgttacgacgcagacgtttttgtaatttgttcaggttgtattgttctttctttgtaatttgttgattttcttgcattatttcagttctctggtactaaatggggcatattgagggcaaactttgcaactacgataaccgcgcattcaacatggctacctgttcgtcgttcatgtcatcaatccacataccgtaaatttcatacaccatctgcgcagtttcatgccccatctggctggctataaatgccgggttcgctcctgccgtcaacagccagcaggcaaaagtatgtcgcgtatggtacggattacggcggcgaataccagcacgttttactgctgcattccatctcgctcccaaatagtcgtagtgaaatctgatggtaaagccttgccttagcatgctggtgttgcgctacccgtacaggatgcggtaacacaggaagaaattagaacagaaactgtggcggacattgtgcattcgttgccaggcggagaaatagaacgctacaacaagtgcagaatataatttttcgcaagtgccagaatagcgatattatgcagtgttttttagttttctatcaggggatattttgtgaaacttttcggtgaataaaataattctctgtaataaatgatgggtatggttggtggttatatttgcacatggaaatattacattggatatgagtgtatttcaaatgaaagagccatgacacccgaatggagttagggattcattacgtatctaatctaaagaataagaaaaatacttaattcattgtgggtggtgatgatatcttgatatgtgaaaatggttctcttaataagatgtaaccagcttattatttatccatagcacaagaaatggtcctgtatctgcgttgccatgaaataagataggcctaaatgtaataaagagttgcatgacaaaattactaaagttcacaataaaaaagaattaagttttttgttcaagtatttttttagtgtattgttttgaaatgttctacgctgctctaaccttcagtctgaagagggcttgaatcgtgatgtcagttcgattgacataatgttattaataatgtttacgtttgaatgtgaaatatgcttaactatgccttgattgttaatcacagggactgactatgagaaaaatactgatgtatttatgtattagcatatggattgttatatcatgcgtgcctatcatattaactagcgagtatttaacagaggcgagtataatggcattgatgtttggtcatgccaatgcactatgtattggggtttttatttctattatttatatagaatgctggaggtaaatagtgtgaacagcattagtttgatgattttatactgaactaaagggggaaagaggtaacgaaaaaagacctccaccaggtacgaatctgaggcgggcagatggaggtcgatatctacacgattaaattgataagtaaaagtcccatcagggattgatttgttcgagtctaatttaaagtaatttcaacgatttggcagaatttcttagagttaatgattttcaagttttcgattaccaggaaaaaggctgggtgctgataaaatagtcatctgcattccttaaattgtgtaagggtgaaaggataaagttcaatttaaaggcggtgcaatattagcaccatcttatatatgtaatgattgatttgcctctttattctactgttgagattattgtttccgaaaattgattattataagcgcgaaaagaaatgctacagcaaataagaggacgattgtcggcgctggggctctatcgagaaaatataataaccatacacctgatattgttattgatatcgttacggcgataagtaatgccttatgaaagcgatgcgtgatgaggacagcaatagaccctggagctattaatagtatatagacagaataatttcgactgcttttaatgtggcaaaaatggtaggcgataccatgcagagtaaaccgtaatgtaataatgatatctgtaatccgctgacttgtgcctgttgatagtcaagacaaaaattcctgaaaaaacgatacctataatggtatctttctttatgatgctattatctttcagatagccagttgcaattgcacaagacagtcctacaataaatgcaccaattcccagcggcatacctataatccaggctagaactatgccaggaaacattgcgtggttcattgcatctcctattagcgcccagccttttaataccaggaaaactgataataatgcacaggggaacgatattataatagcgattatcaatgcataattcataaatttaaattgtaatgattagaggggaaaatgtcagcacatttgcgaaatgaatcaaaaagcccgcagcaatgtgcgggcgttagtgtcagcgcacaaccagcacggagcactctgcgtgacgcactacagctgcggcgttagaaccgagcagataagtggtgatatccggtcgatgggaagcaatgatgatcatatgagcggggatcttcttcgccaattccagaatgcggtctttgggcgagccttcttcaacatggacatgcactctgtcggttggcagtttaaattttttaatgatctcttccagttgcgatttggcttccgctttcagatcatccattgccggtaattctgcggaataggctaaacccagagaggcatagtagggcagcgaaggtattaccgtcaggaaatgaacctctgcatcatcaatctttgcctctgcctcaacgtggctaatcacgcgttgagttaattctgaatcggaaatatcgatagggacaagaatcgttctgttcataaaacctcctgttttagtatccgcataaagtgtaacgccagatgacactttttgtgtaatgacggagttcacatttttaatttagatcaaaggaggaagaataagcagaaaaagcccgccaaaacagcgggcagggggatttagaactgataaaccagacctaaagcgacgatatcatcggtagagatgccgttggcagcgtagaaactgtcatcttcatccaacaggttgattttatagtcaacataggtggacatgtttttattgaaatagtaagtcgcgccaacatcggcgtatttaaccagatctttatcatcaacacctgccgggttgtctgcaccaccggcagcgtgcaggtcacggcctttagacatcaggaaagagactgccggacgcagaccaaaatcaaactggtactgtgcagtgacttcaaagttctgggttttgtttgcaacagcataatcgctgtcgccaaacggggtcatattacgcgtttctgaatacatggttgccaggtaaatattgttagcatcgtattttagcccagcagtccacgcgtctgctttatcaccacctgccgcagtatggttaacctggtcattggtgcggtcagaagaggtgtatgccgcaccagcgctaaagcccatgccctaaatcatatgttgtggaaagaccccagccgtcaccgttttcatggcgaacatcacgtccgttgttggtgccttcctgaccattactggcaccttcgttgttaccttgatactgcaccgcgaagttcagaccatttaccagaccgaagaaatcagtattacgataagtcgcgacgccattggcacgaccagtcataaagttgtctgcattggtataagagtcaccgccaaattcaggtagcatatcagtccagccttcgatgtcgtacattacgccataattacgtccgtaatcgaaagaaccgtaatctgcaaatttcagtccggcaaatgccagacgggtccatgactggtttgttgaagattcggtgttgtttgcctgaatattgtattcccattgaccgtagccagtgagttgatcgttaatttgggtttcgcctttaaaacccagacgagcatagctctggtcgccatctttcgctgaattatcagaaaaataatgcaggccatcaactttgccatacagatctaatttgttgccgtctttattataaacttcggctgcatgtgcagcacctgcagcgagcagggcaggaattaagagtgccagtactttgcttttcattgaataaatcctttagttattttatttgcctttcatccccattttggggagtgaaaacatcctaaaggagaagttcagttagccgataaatatcatttgttacgccttaagtaaaaccttaattaaataattcttcagaaatgataataagtctggtgaatgtattggagataacacatacaaaataaaaattatacttttaattttctatacgttattctgcgcgggttatatgcctttattgtcacagattttattttctgttgggccattgcattgctactgatttccaacatataagaagacaagcccgaacagtcgtccgggcttttttttagaattggatgatccttatccagagcatttaatcggtgttgcttttttccgcttttccggccatttgtgccaggaagtcatagcgtttttgcaaatcagctgcagcatctttccataactgttccgccacttctggctgctgcgaattcagacgacggaaacgctgctcgtgaagtaacgtttcttccagtgcttctgacggcgggcgtgaatccagcgccagcggcagtttgccttcatcggcacgacgaggatcgaagcgatataacggccagaagccggtagcagtgagttggcgcatctgatcgtggctgagtgccagatcgtaaccatgctcttcacatgggctataagcgatgatcagcgatggccccggatacgcttccgcttcctgaatcgctttcaccgtctggttcagctgcgcgccgagagaaatctgcgccacataaacatgaccgtacatcatcatactgacgccaagatctttacgcgctttacgtttgccatgctcgccaaacttagttactgcacccagcggtgtcgctttcgatgcctgaccaccggtgttggaatagcattgcgtatccagcaccagaatgttgacgttttccgtcaaactcaatacatgatccagaccgccaaagccgatatcgtaagcccagccatcgccaccaatcagccagattgatttttccaccagggcatctgcgtcacgcagcagttcatgtgcttcagcaacatcgttgagttgctggcgtaaagctgcaacctgttcacgacgaacctctggcgtggcgtctgatttcaacgcagtcagtaattccgccgggattttatcggcaaattgatcgagcagacgcagcacgcggacacggtgttgatcgaccgtcaggcggaaaccaaggccaaattcggcgttatcttcaaacagcgagttcgcccatgccggtccacgaccattggcatcggtggtatatggtgttgaaggcaggttaccgccgtatattgaagaacagccagtggcattagcgatcaacatccggtcgccatagagctgagtcagcaatttaatatacggcgtctcgccacaaccggagcaagcaccggaatattcaaacagcggtgtaatcagctgcgatgtacgaatatcaatacgttccagtttgctacgatcgatttctggcaggttgaggaagaaatcgtaattgattttctcttcttcgacatgttccaggcgcgacatcatattgatggctttaatctctggattctgacggtctttcgccgggcaaacttcgacgcacaggttacaaccggtgcaatcttccggagccacctgcaagacatatttctgcccgcgcatatcacgcgatttcacatccagcgaatgcaggctggcaggggcgttttccatcgcttcaggcggtaccacttttgcgcgaatagctgagtgtgggcaagcggcgacacagtggttacattgggtacagagttcctctttccagatggggatctcttcggcgatattgcgtttttcccagcgcgtggtgcccatcggccaggtgccgtctggcggcagcgccgaaacggggagggcgtcgccaagcccggcgagcatcgcagcggttacggttttcacaaaatcaggagcggcatcggaaaccactggcggtcgattggcgctatgcggattaactggctgcagtggaacttcttctacggattcacgtgccagcgccagagcctgccagttgcgttccaccagatcctggcttttgctactgtaacttttggcaatcgcaccctgcaattctgccagggcgctatcgccaggcagaatctgcgtcagatggaaaaaagccatctgcatgacggtattaatacgggccgccaggccacattcgcgggcgattttcgccgcgttaatcacatagaagcgcgcttttttctggtttagcacggcctgaacttcctgcggcaagcgcgaccacacttcagctgcgctgtacggcgtgttgagcaggaaaatgccgccaggttttaaacgctcagccatctgatatttatcgataaactgcaactggtggcagccaacaaaatcagcctgggaaatgagataagcggaacgaatcggctgttcgctcacgcgaaggtgagaaaccgtcaggccgcccgcctttttggagtcgtaaacaaaatagccctgtgcgtaccacggcgtggaatttccgataatcttgatattgtttttggtcgcggaaacgctgccatcactaccaaggccataaaacaaggcttccagtttcgccgagtttggtagggtgttttccggcaacggcagtgacagattggttacatcatcgtaaataccaaccgtaaagcgcgctttcggtttagccgcgttgagctcggcaaataccgccagtacacagtccgggccaaattctttggatgaaagaccatagcgcccaccaatgacacggggcagggtttcacgctcgccattattaaaggcttctgccagtgcggtcatcacatccagatagagcggttctgcctgggcaccaggctctttggttctgtccagtaccgccacgttgcgcacggatcccggcagagcttgcagcaagtgtttggcggagaaggggcggtacaggcgaactttcagcacgccgactttttcgccacgggtcagcaattcatcaaccacttcttcacatgtgccaatggctgagcccatcaggataattacccgttccgcttgcggatgcccgtaatactcaaacggctgatactgacgacctgtcgcggcagcgaaatcattcatcgcctgttcaacatggtcatagaccgcgttgtaccatgggttggtggcttcgcgagactggaaataagtgtcaggattggcggacgtaccgcggatcaccggatgttccgggttgagtgcccgggcgcgatgagcatcaatttctgcctgcggcatcagttcaagaatcgtgtcatcggccagcgggacaattttattgatttcgtgagatgtgcggaaaccatcaaagaaatgaataaatggcacgcggcttttcagcgtcgcgatgtgcgaaatgagagcaaagtcttgcgcttcctggacgcttgctgcacacaacatcgcgcaacccgtttggcgcaccgccataacgtcggaatgatcgccaaaaatagagagtgcatgtgtggcaacggtacgtgccgcaacatgcaggacaaacggcgtcagttcgcctgccagtttgtacagcgttgggatcatcagcagcaaaccctgcgatgacgtaaacgatgttgagagggcaccagtttgcaaagcaccatgcacggtagcgatagcacccgcttccgactgcatttcaaccacgcgtggtgtgtctccccaaacgtttttcaagccgtttccggcccatgcatcagcctgttctgccatcgtggaactgggggtaatagggtagatggcgataacttcactggtgcgaaacgccaccgaagcaaccgcgccattaccgtcaatagtaatcatatgacacccttacattgcgcaaatgaggggcgcacgaaattgctgcgcgcccagtagtaatcgttcaattttagcaaatggctttcttctgcattttcgcttttgtgtcccccacatcagcgtaatgaatgttttgatcaaacagagggcaaaaaaatagccataaaaaagtaaaaatgcggggcaacgcgcaggacagctctcgacgccgccctctgtgctgcctattatttatggcggtgtcgtttggcttgaagatcagaggaagaaaagatgcgagcagcgttttgggtagggtgtgccgctttattgttgtcggcgtgtagtagtgaacctgttcagcaggcgactgcggcgcacgtagcgccaggtttaaaagcgtcgatgtccagtagtggagaagcaaattgtgcaatgatcggcggttcgctttctgttgcccgtcaactggatggtacggcgattgggatgtgtgcattacccaacggcaaacgctgtagcgaacagtcacttgccgccgggagctgtggcagctattaattcattaaatccgccagcttataagttaatgtctgtttcgcggtcgccagcgttaactggttcgcggtcagatccacttgtgcaccttctttcagcatttcgctaatggtgttatcgagttcattaagctgcgggttagcgcacatcatacgggtcattgccagccctttggcggtcagttcaccattagacagtttgccttcaccgctaaagcggttacacatgctgccggaaatcatcatcttttcaccaaagctgatttctggcggatttttatcgctggtcacgggcttaccgtttacgctttccagcacaaagcgatgatgctgtagctgttctggcgttacagcaattttgtcactacttacacatcccgccatcagcaggcttagcgcaacaagcgcggctactttcttcattgtggttctcaattactgtttctgattcaggactattttaagaatagaggatgaaaggtctttggggattatctgaataagctcccctggaatgcaggggagcggcaagattaaaccagttcgttcgggcaggtttcgcctttttccagattgcttaagttttgcagcgtagtctgagaaatactggtcagagcttctgctgtcaggaatgcctggtgcccggtaaacaacacgttgtggcaggcagacaagcgacggaatacgtcatcctggatcacgtcgttggatttatcttcaaagaacagatcgcgttcgttctcatacacgtccatacccaacgaaccaattttctgatttttcagcgcttcaattgccgcctgagaatcaatcaatgcaccgcgactggtattgacgatcatcacgccatttttcatctgatcgaaggcggcttcgttcaacagatggtagttttccggtgtcagcgggcagtgcagagagataacgtctgattcagagaacagggttggcagatcgacatactccacaccgagttccagcgccgccgcacttggatacggatcgaacgccagcagacgcataccaaaacctttcagaatgcgcagcatcgccacaccgattttaccggtaccgataacgcctgccgttttgccatacatagtaaagccggtcagaccttccagagagaagttagcgtcacgggtacgctgatacgcgcggtgaatacggcggttcagcgtcatcatcataccgatggcgtgttcagcaacggcctctggatcataggctggaacacggactactttgagccccagttcttttgccgcgtcaaggtcgacgttattgaaaccggcacagcgcagggcgatatatttaacgccgtgctttttcagctcttccagcaccgggcggctgccgtcatcgtttacgaaaatacataccgcttcgcagccattggcagttttagcggttttttccgtcagcagaaagtcaaaaaattccagctcaaagccaaaggactcgttcacctgttgcaggtacttcttgtcgtactgttttgtgctataaacggcgagtttcataagactttctccagtgatgttgaatcacatttaagctactaaaaatattttacaaaatttcaaatataattgaaagatatggcgatattgaaaaattcatcaacaactatgcttagtgtaggcgcaaccttcaactgaacggttaaacatgccacaatacccgtattgaatgcttaatttttcgctaaatcaggatattaactacccatgctgggtaaatataaagccgttctcgcgctgttattactgattattcttgtgccgttgacgctgctgatgacgctcgggctgtgggttcccacgctggcgggcatctggctaccgctcgggacacgtattgcattagatgaaagcccacgcattacgcgtaaaggtttaatcatccccgatctccgttatctggtgggagattgtcagcttgcgcatatcaccaacgccagcctttcacatcccagccgctggttattgagcgtcggcacggtagaacttgattctgcttgtctggcgaaattgccgcagacggagcaatcgccagccgctccaaaaaccctcgcgcagtggcagtccatgctgcctaacacctggatcaatatcgataaactgattttttctccctggcaggaatggcagggaaaactctctctcgcattaacctccgatatccagcaactgcgttatcagggcgaaaaagttaaatttcaaggccagctgaaagggcaacaacttacagtcagcgaactggatgtcgccgcgtttgaaaatcagccgccggtaaaactggtgggggaatttactatgccgctcgtgccggatggacttccggtaagtggtcatgctactgcgacgttaaacttaccgcaggagccttcactggtggatgccgagctggactggcaggaaaatagcgggcaattgattgtgctggcacgggataacggcgatccgttgctcgatttgccgtggcaaattactcgtcaacaattgaccgtaagcgatggtcgctggagctggccgtatgcaggttttcctttaagtggccgactgggtgttaaagtcgacaactggcaggcagggctcgagaacgctctggtcagcgggcgactgagtgtgctgacccaggggcaagcgggtaaaggcaacgcggtgttaaattttggcccaggaaaattaagcatggataacagccagctgcctctgcagctgaccggtgaagcgaaacaggcggacctcattttatatgcccgtttacctgcgcagctaagtggaagtctgtctgacccaacgctgacctttgagcctggcgcgttacttcgttcaaagggaagagtcattgattcgctggacatcgatgaaatccgctggcctttagcgggtgtaaaagtcacccaacgtggtgttgacggacgtttgcaggccattttgcaggcgcatgaaaatgaactgggcgatttcgtgctacatatggatgggctggcgaatgattttctccctgacgctggccgctggcagtggcgctactggggaaaagggagttttacaccgatgaatgccacctgggatgtcgcaggaaaaggtgagtggcatgacagcacgattacgctgaccgatctctccaccggtttcgaccagttacaatacggtacgatgacggtagtaaagccgagattaattctcgacaagcccgtcgtctgggtacgtgacgcacagcatccctccttcagcggcgcgctgtcactggacgccgggcaaacgctgttcactggcggcagtgtgttaccgccatcaaccttaaaatttagcgtcgatgggcgcgatccgacgtatttcctctttaaaggcgatttacatgctggtgagattggcccggttcgggtaaatggtcgctgggacggtattcgtctgcgcggtaacgcctggtggcctaaacaatcactgactgtattccagccgctggtgccacccgactggaagatgaacttacgcgatggtgaactgtatgctcaggttgcattttcagctgcgcctgaacaaggattccgcgcgggagggcacggcgtgttgaaaggcggtagtgcctggatgccagataatcaggttaacggtgtcgattttgtcctgcctttccgttttgccgatggagcctggcatctggggactcgcggccccgttacgttgcgaattgccgaagtgattaatctggtgacagcgaaaaatattacggctgatttgcaaggtcgttatccgtggactgaagaagaaccattgctgttgactgatgttagcgtcgatgtgttaggcggtaacgtgctgatgaaacaattacgtatgccgcaacatgacccggcgctgttgcggctgaataatctttcctccagcgaactggttagcgccgtcaatccgaaacaattcgccatgtccggggcatttagtggtgcattgccgttatggctaaacaacgaaaaatggatagtgaaagacggctggctggcaaatagcgggccgatgaccttgcggctggataaagacaccgcagatgcggtggtgaaagacaatatgaccgcgggttcagcaattaactggttgcgctatatggaaattagccgttcatcgacaaaaattaatttagataatctcggtttattaaccatgcaggccaatattacaggtaccagtcgcgttgatggtaaaagcggtacggtaaatcttaattaccatcatgaagagaatatttttacgctgtggcgcagtttacgctttggcgataatctccaggcatggctggagcagaacgcgcatctaccgggaaatgactgtccgcaaggaaaagagtgtgaggataaacaatgaaaattttactggctgcgttgacgtcatcttttatgctggttggctgtacgcctcgcattgaagtcgctgcacctaaggaaccgatcactatcaatatgaacgttaaaattgagcatgagatcatcatcaaggcagacaaagatgtcgaagagctgcttgagacccgtagcgatcttttttgaggtgatgatgaaaagaacattacttctttgtgcatttcttgttggcttggtaagcagcaatgtaatggcattgactctggatgaagccagaactcaggggcgggtaggggaaacattttatggttatctggttgcgctgaaaacagatgctgaaactgagaaattagtaaccgacatcaatgccgaacgtaaagcgagctatcaacaactggcaaagcagaataatgtgtcggtggatgatatcgcgaaactcgccgggcaaaagcttgtagaacgggccaaacccggggaatatgtacaagggataaacggtaaatgggtgcgaaaattttaatagcaaaaccgcaatatcgggataacgctacaggagaagacgattaatctattttccggaaacattttgctcttttaattataaggatgagttatgtttccgctctaatttatttattcgagtattgattttatacccttttttcattaaataaatatctatgtgacgcatttgaatttataatttatataatatacataatttgtatgtttcgcgggtttatttatttctctgtattataaatccagattgtcagagaatatgtttgattaggtaacaatctactggcaatattggacgtcctctatgttttaaataatcaattggtcgggtcagggtatctgaccttctttatattcgccagaaggatttattatgcaaaggaaaactctattgtcggcctgtattgcattagctctgagtggtcagggttgggcggcagatattacagaaatagaaaccaccacaggtgaaaagaaaaataccaatgtgacttgtccagcagatcctggaaaactcagtccagaagagcttaaacgcttaccctctgaatgctcctctgtagtcgaacagaacctgatgccatggcttgtcacaggtgctgctactgcgttaatcacaaccttagccatagtggaactaaacgacgatgatgatcatcatcgcaataattctccacttccaccaactccacctgatgatgattcagacgacactccagttcctccaactcctggcggagatgagataataccagacgatggtccggatgataccccgacgcctcccaaaccgatttcgtttaataattacgttatcctcgataaaacagaaaaaacgttaactattcgcgattcagtttttacttataccgagaatgctgacgggactatttctctgcaagatagcaatgggcgtaaggcgactattaatctttggcagattgatgaaacgaataacacggttgcccttgaagggatgagcgcagatggtgcaacgaagtggcaatataatcacaacggtgagctcgttattacgggcgacaataccacagtaaacaacactggaaaaaccatcgtcgacggcaaaggcgccaccggaactgaaatcgcgggtaataacgcggtggtgaaccaggacggcgagctggatgtgagcggcggtggtcacggtattgatatcaccggcgacagcgcaacggtggataacaaaggcggtatgaccgtcaccgatccggattcgattggcattcagatcgacggcgacaaggcggttgtcaataacgacggtgacagtgccgtcagtaacggcggcaccggcacgcaggttaacggcgacgaagccaccgtaaacaataacggcagcaccaccgttgacggcaaggattccacgggcaccgagataaacggtgacaaagccatcgtcaacaacgacggcgacagcacgatccttgatggcggcaccggaacccgcattacgggtgatgatgcgacggccaacaacagtggcaataccaccgttgacggacagggttcgaccggaactgaaatcgcgggtaacaacgcggtggtgaaccaggacggcgagctggatgtgagcggcggtggtcacggtattgatatcaccggcgacagcgcaacggtggacaacaaaggcggcatgaccgttgcggatgcggattcgattggcattcagatcgacggcgacaaggcggttgtcaataacgacggtgacaatgccatcagcaacggcggcaccggcacgcaggttaacggcgacgaagccatcgtgaacaataacggcaacaccaccgttgacggcaaggattccacgggtaccgagataaacggtgacaaagctatcgtcaacaacgacggtgacagcacgatccttgatggcggcaccggaacccgcattacgggtgatgatgcgacggccaacaacagtggcaataccaccgttgatggtcagggttcgaccgggactgaaatcgcgggtaataacgcggtggtgaatcaggacggcgagctggatgtgagcggcggcggtcacggtattgatatcaccggcgacagcgcaacggtggacaacaaaggcggtatgaccgtcgcggatgcggattcgattggcattcagatagacggcgacaaggcggtcgtgaacaacgacggcgacagcacgatccttgatggcggcaccggaacccgcattacgggtgatgatgcgacggccaacaacagcggcaataccaccgttgatggtcagggttcgaccggaactgaaatcgcgggtaacaacgcggtggtgaaccaggacggcgagctggatgtgagcggcggcggtcacggtattgatatcaccggcgacagtgcaacggtggataacaaaggcggtatgaccgttgcggatgcggattcgattggcattcagatagacggcgacaaggcggtcgtgaacaacgacggtgacaatgccatcagcaacggcggcaccggcacgcaggttaacggtgatgaagccaccgtgaacaataacggtaaaaccaccgttgatggtcagggctcgatcggtaccgaaatcgcgggtaataacgcggtggtgaatcaggacggtacactggatgtgagcggcggcggccacggtattgatatcaccggcgacagcgcgacggtggacaacaaaggcggcatgactgtcaccgatccggattccatcggtattcagatcgacggcgacaaggcggtcgtgaacaacgacggtgacagtgccatcagcaacggcggcaccggcacgcaggttaacggcgatgaagccaccgtaaacaataacggcagcaccaccgttgacggaaaagattccacaggcactgagattaacggtgacaaagccatcgtcaacaacgacggtgacagcacgatccttgatggcggcaccggaacccgcattacgggtgatgatgcgacggccaacaacagtggcaataccaccgttgacggacagggttcgaccggaactgaaatcgcgggtaacaacgcggtggtgaaccaggacggcttactggatgtgagcggcggcggtcacggcattgatatcactggtgatagcgccactgtaatcaacaaaggcaatataactgtcacggataaagattcggttggtgtgctgattaacggtgatcgagcgacctttgccaatacgggtcatattgacgtcaataattcagctactggcatgagcatcacgaccagcgagggggccatctccctggcaggtagtatgaatgttggtgacttttcaacaggcatggcgctcagtggtaatagcaacagtgtgacgctggcggcgaaagatctgaacgtgaccgggcagaaggcaacgggcgtcaacatctctggtgacaataatgccgttgatatcactggtaatattttggtagataaagatcaaaccgcgactaacgcggtagattatttttacgaaccgtctattggtgtgaacgttagcggaaacagtaacactgtatcgctagacggcaagttaactgtggtggctgacagtgaacttacctcacatatttatgctgactttgatggaagccaggagaatatttccgggcttgtcgtatctggtgatgataataccgtgtatctgaatggtggtatccagctggttggtgaagaaaatcaattgactgatggttctaccgtcgcatcaaaccgcaagggctatggcaaaacaccagtaatcactgttgatgggaagtcgtctatttacctgaacggggactccacgattaacggtgatttacctctagcctattcagggatgattcggttgaagaatagcgccatgattgagatcggaacggatgccacgattaacatgcaggtagatagttatgatcactatgcgagatctgaagctcaaatcatctttgtagagtctggtgctgagttaattaataaaggtgatattgatactcgaaatattggttttgccgctatttctggtgaaaattcaacgggaagtaacagtggcaatattactctttctcagtacaactatggcttgttagcaaatgcaggagttggctatttcacgactaaaggcggtagtgcggttaataatggtacgattactgcgaaagtcatggaacaagaaagtgtcattaatttgggagcgtctctgggtctgaatgaggcgaacactttctactctgatgcgaacagtatgatgggtcttgatgcctttgatcacggatacgtgtccaatgaaagcggtggcagcattgagatgtatggtcgcggcaacgttggtatgttggctattgatgagagtacagcagaaaacgctgggcaaattacactggatgccctgtgggttgatgcagatgataccaccactttgcgcagcaatattggtaatgatgccaggagctatgccgttggtatggcagtaggtacaaatacttacagtgggccaaggaaaaatgctacggccgttaataaacagggtggtgtaataacggtttataatgctggaataggtatggccgcctatggtgccagcaataccgtgattaacgagggtattatcaacctggagaaaaatgctaactacgatagtagtctgggagcaaattctctgatcggtatggccgcctataaaagtggtactgccattaatgaacagtccggcgtaattaatatcaatgctgacaatgggcaggcgttttatagtgatggaaccggtactattcttaactatggaacgatttgtgttaacaccaattgcctgacgggcaatgactataatgagactgactcttatacctcgttactttacacgggtggcgatgtaatcactgcgcagaatgaaacacaaagtctggctcaaaaagccacgattaacgacaaaaaagaaggcaatgttgttaacagtggttcgctttccggtgctgatattgcgattagtagcggtgaattagttaatacatcgacgggtattattaataatgccatcattatcaatgacggagagttaagtaacgaaggctctgtggcgaaggtgacgctaaacgcaggcacgttcgggaacatcggtacggttaactcgcgtatgttccagacaggagggacatttaataaccagcaaggtggggtcgtgcaaaacggtgctaacctgagtaaaactgcaatcgccaataacgcgggtacctggtatctcggtgccagcagtagtagtgatagcaataatgccagcatgatggagatttataatactgcggtgtttaacaacagcggtgacttcattctgaataacagcagaaatgctgttcacttatatcagtcagggacgttctacaataccggtcatatgttaatttctggtgctaactatagcggtaacgcaattaattactggaacgcgaataataatggacggttcattaatagtggtactgttgatgttactgcaaaagcgctagcgaccagcggtgttgatgccagtaccaaccatgcatacttctggaaccaaaatagtggtatagtcaattttgataaagacagcggcgttgctgtgaaattcacccacagtaattatgttgcacagaatgatggcaccatgaatattagcggtaataacgctattgcgatggaagggaataaaaatgcacagttgattaacaacggcacgattaatcttggagcacaaggtacgacagataccggtatgataggtatgcagctggatagcagtgcgacggctgatgcggtgatcgagaataatggtactatcaacatatacgctaataattcctttgcgtttagcatgctaggttccgtaggccacctcgtgaataacggtacggtaaccattgcagatggggtgacgggggccgggctgattaagcaaggtaatagcgttaacattgaaggtgtcaatggcaataacggcaataatagtgaagtgcattatgctaattacacactgccagatgtgcccggctcgtcagttttcgtatctaccgacaatgtttcagataatggaggccagaacaacctaaatggctatgttgtgggaaccagttctgatggcagcgcaggtaagttgaaagtgagcaatgcaagcctgaagggtgtttccgttaacactggatttacgtcaggaacaagtgcgacttctgttacattcgataatgtggttcaaggtaacaatcttacggatgctgataccattacatcgacctctgtcgtgtggagcgcacaaggtaacaccgatgctaatggcaacgtagacgtcacgatgaccaaaaacgcctatacggatgttgtgacggattcttcagttaataatgtcgctcaggtactggatacgggttacaccaataacgacctgtacactagtctgaacgtaggaacgactgctgaactgaacagtgcgctgaaacaggtcagcggcagccaggcaacaacggtatttaatgaagcacgagtgttaagtaaccgcttcagcatgttgtccgatgcagcaccggaagttgcaaacggtctggccttcaacgtggtagcgaaaggcgacccgcgtgctgaactgggaaataatacacagtacgacatgatggcgctgcgtaaatccatgacactgactgaatatcagaatctgagtctggaatacggtattgcgcgtctggagggtaatggttcagataccgcaggcgataatggtgtgactggcggttacagccagttcttcggtctgaaacaccagatggcgtttgacaacggtatgagctggaataacgccctgcgttatgatgtgcataatctcgatagcagtcgctcgatagcttacggcgacgtcaacaaaaccgctgatgcgaatgtgaaacaacagtacctggagttccgtagtgaaggggcaaaaacctttgaactgcgtgaaggtctgaatgtgacgccttatgcgggtgtgaaactgcgtcatacgctggaaggtggctatcaggaacgcaatgcgggtgactttaacctgagcatgaacagcggcagcgaaacggcggtggacagcatcgttgggctgaaactggactatgcagggaaagaaggctggagtgcgaacgccacgctggaaggtgggccgaatctgagctatgtgaaaagtcagcgaactgcgagcgtttcgggcgcgggaagccagcgtttcaacattgatgatggtcagaatggtggtggtttcaacagcctggcgacaatgggtgtgaaatacagtagccaggagagtgcattgcaggtagatgcattccactggaaagaagacggcatcagtgataaaggtgtgatgctaaacttcaagaaaacgttctaatttttagcatgtaatacataaaccgcaacgctgatacaggttgcggtttttttattgccggatgcggtgtttgacgtgtcttaacctgtctggggggcgtgtctttcagggcaacagtacaactcatcccgcaatcttgtttacaccctcgcattatttatctcttttcgtttctatactgatttttcttaatcggttttattacagggcagggtgcgatgagcagcaacacatttactctcggtacaaaatccgttaaccgtcttggttatggcgcgatgcaactggctggtcctggggtttttggccccccaagagatcgccacgtcgctataaccgtgctgcgcgaggcgctggcattgggcgtcaatcatattgataccagcgacttttatggtccgcacgtcaccaatcagattatccgcgaagcgctttatccttactctgacgacctgacaattgtcactaaaattggtgcgcggcgtggagaggacgcttcctggttacccgcattttctccggcagagctgcaaaaagcggtacacgataatctacgtaatctcggcctggacgtactggatgtggttaacctgcgcgttatgatgggggatggtcatggcccagcggaaggatcgattgaggccagcctgacagtgctggcggagatgcaacaacaaggcctggtaaaacatattggcctgagtaacgtcacaccgacgcaggttgcagaggcgcgaaagattgccgaaatcgtctgcgtgcagaacgaatacaacattgcccaccgtgctgatgacgcaatgattgatgctttggctcgtgatggcattgcctacgtgccattctttccgctcgggggctttacgccgctgcaatcctccacgctttccgatgttgctacaagccttaatgcgacaccaatgcaggtggcgctggcgtggctgttacagcgttcaccgaatattttgctgattcctggcacctcttcggtggggcatctgcgggagaatatggcgtccgatgaattagtgctaacggatgacgtgctggcaacgctggacagtattgcgcaaaaggcgggttaaataaaaaaacctcccactttcgtgggaggcatcataaatcttatgcagcaacaatactgtcgatggctgctttcgcgtcagactgcgctttcgctgccatttccgggccgtacgcgatcccttcggcgaagacaaatttcacatcggtaatgccgataaagcccaggaatgtggacagatatggcgttaccagatccgttgggccatctttatggatcccaccgcggctggtgataacgatggcttttttaccggtgaccaggccttccggacccttctcggtatagcggaaagtaacgcctgcacgtgcaaccaggtcaaaatagtttttcaactgggtcgagatattgaagttatacatcggtgccgcaataacgataacgtcgtgggctttcagctcggcaatcagctcatcggaaagcgccagagcttcctgctgacgcggagtcagcggcgcatcgctcggacgcagtgcaccaaccagttcgccatccaggaccggaatcggatttgcagccaggtcacgcacggtgatttcatcagcggagtgcttttcgcgccattgttcaacaaaataatcggacaactgattagactgagagtaccctgccaggatgctggatttaagaactaataccttgctcatggtgtttccttatagatatttgaatgggcaatgccccgttgcttgttgacactttattcacaattctgccacagagatagcgcaataaatcgaagcctatgttcgaatttattgaacaacgcatagaaagccgcgatgtggtactctatatctatcatttaaaagaaaattaatcaggcagactactgcccactaacgttatgacagaacaacaaaaattgacctttactgccttgcagcagcggctggattcgatgatgctgcgtgacagactgcgtttttctcgccgtctgcacggcgtgaagaaggttaaaaatcctgatgcacaacaggccattttccaggagatggcgaaagagattgaccatgcggcagggaaagtcctgctgcgtgaagcggcacgaccggagattacttacccggacaatttgccggttagtcagaaaaagcaggacattctcgaagcgattcgtgaccaccaggtggtgatcgtcgccggggaaacgggttccggtaaaacgactcagctaccgaaaatctgtatggagctgggtcgcgggattaaagggctgatcggccatacccagccgcgtcggctggcggcgcgaacggtggcgaaccgtattgcggaagagctaaaaacggagccgggcggttgcatcggttacaaagtgcgtttcagcgatcacgtaagtgataacacgatggtcaagctgatgaccgacggtatcctgctggcggagatccagcaagaccgcctgctgatgcagtacgacaccatcattattgacgaagcgcacgaacgtagcctgaatatcgattttctgctcggctatttgaaagagttgctgccgcgacgtcctgacctaaaaatcattatcacttccgcgactatcgacccggaacgcttttcgcgccactttaataatgcgccgattatcgaagtctccggtcggacctatccggtggaagtgcgctatcgcccgattgttgaagaagccgatgacaccgagcgcgatcagttgcaggcgatttttgacgctgtagacgaactgagtcaggaaagccccggcgacattctgatctttatgagcggtgagcgggaaattcgcgataccgccgatgcgctgaacaagctaaatctgcggcataccgaaatcttgccgctttatgcgcggctttcgaacagcgaacaaaatagggtgttccagtcgcacagcgggcgacgcattgtgctggcgaccaacgtcgcggaaacgtcgctgaccgtaccggggattaaatacgttatcgaccccggtacagcgcgtatcagccgctacagctatcgcaccaaagtgcagcgtttgccgattgaacccatttctcaggcgtctgccaatcagcgtaaaggccgctgtggtcgtgtgtccgaagggatctgtattcgtctctattccgaagacgatttcctctcgcgcccggagtttaccgacccagaaattctacgtactaacctggcctcggttattttgcagatgaccgcactgggcttgggcgatatcgccgcattcccgtttgtcgaagcaccggataaacgcaatatccaggatggcgtgcgtctgctcgaagaactgggcgcgatcaccacggatgaacaggccagcgcctataaactgacgccgcttggtcgccagctctcgcagttgcctgtcgacccacgtctggcgcgtatggtgctggaagcgcaaaaacatggctgcgtgcgtgaggcgatgattatcacatccgcgctctccattcaggatccgcgtgagcgtccgatggataaacagcaggcatctgacgaaaaacatcgtcgcttccacgacaaagagtctgacttcctggcatttgtgaatctgtggaattatcttggcgagcagcaaaaggcgctttcttcaaacgccttccgtcgcctgtgtcgtactgattatctcaactatctgcgcgtgcgcgaatggcaggatatctacactcagttgcgccaggtggtgaaagaacttggcattccggttaacagcgaaccggcggattatcgcgaaattcacattgcgttgctgaccggtttgctttcgcatatcggcatgaaagatgccgataaacaagaatataccggcgcacgtaacgcgcgtttctccatctttcccggttctggtttattcaaaaagccgccgaaatgggtaatggtggcggaactggtagaaaccagccgcctgtgggggcgcattgcggcacgcatcgatccagaatgggtggaacctgtcgctcagcatttaatcaaacgcacctacagcgaaccgcactgggaacgggcgcagggcgcggtgatggcaacggaaaaagtcaccgtttacgggttgccgattgttgctgcgcgtaaggtcaactacagccagatcgatccggcgttatgtcgtgaactctttattcgccacgcgctggtggaaggtgactggcagacgcgtcacgcattcttccgtgaaaacctgaaactacgggccgaagtggaagaactggaacacaaaactcgtcgccgcgatattctggtggatgacgaaacgttgtttgagttctacgaccagcgcatcagccacgatgtgatctccgcacgccatttcgacagctggtggaaaaaagtcagccgcgaaacgcctgatttgctcaactttgaaaagagcatgttgatcaaagaaggggcggaaaaaatcagcaaactggattacccgaacttctggcatcagggcaatctcaaactgcgtttgagctatcagtttgagcccggcgcggatgctgacggtgtgaccgtgcatatcccgctgccgctacttaaccaggttgaggagagtgggtttgagtggcagatccccggtctgcgtcgtgagctgatcatcgccctgattaaatcgctgccgaagccggtacgccgtaattttgtgcccgcgccaaacttcgccgaagcgtttttaggccgcgtcacaccgctggaattgccgttgctcgacagccttgaacgagagttacggcggatgactggcgtcaccgttgaccgcgaagactggcactgggatcaggtgcccgatcacctgaaaatcactttccgcgtggtggatgacaaaaacaagaagctaaaagaagggcgctcattacaggatctgaaagacgccctgaaaggcaaagtgcaggaaacgctgtctgccgtggcggatgacggtatcgagcagagcggtttacatatctggagttttggtcaactgccggaaagctacgagcagaagcgcggcaactacaaagtgaaggcttggccggcgctggtggatgagcgtgacagcgtagcgatcaaactgtttgataacccgctggaacagaagcaggcaatgtggagcggtcttcgccgtttactgctgctaaatattccatcgccgatcaagtacttgcacgaaaagctgccaaacaaagccaagctggggctgtactttaacccatatggcaaagtgctggagctgatcgatgactgtatctcctgcggtgtggatcaactgatcgacgccaatggtggcccggtctggacggaagaaggctttgctgcgctgcatgaaaaagtccgcgctgaactgaacgacacggtggtggatattgcgaagcaggtcgagcaaatcctcactgcggtgttcaatatcaacaaacgtctgaaagggcgggtggatatgaccatggcgctggggctttctgacattaaagcgcagatgggcgggctggtgtatcgcggttttgtcactggtaacggcttcaaacgactgggcgacacgctgcgatatttgcaggcaattgaaaaacgactggaaaaactggcggtcgatccacatcgcgaccgtgctcagatgctgaaagtcgaaaacgtccagcaggcatggcagcaatggatcaacaaactaccgcctgcacgtcgtgaggatgaagacgtgaaagaggtccgctggatgatagaagagctgcgcgttagttacttcgctcaacaacttgggacgccttatccgatttcggataagcgtattttgcaggcgatggagcagattagcggttaacactgctatttgcctgataaatctaaaacccggtaagcatttagcgccgggttttttattaattctaaaaacgataagggaaaaaattcaggagttcagaaaaatacaattctctgctgcaagatgaataatgtttatctacagcatttccttaaaaaatatgtcaggcttgcggagtggcagttaaggaaatacgacttcctcctttcagagtgctccgcttctcactattatctcacgcagtattcttaagggaacgataaggaggaaccatgaatattaccccgtttccgacgctttcgccggcaaccatagatgccataaatgttatcggacagtggctggcgcaggatgatttctccggtgaggtgccgtatcaggccgattgcgtgatccttgcaggcaatgcggttatgccgactatcgatgcggcatgtaagattgcccgcgatcagcaaattcctttactgattagtggtggtatcggtcactcgacaacttttttgtatagcgccatcgcacaacatccgcactacaacactatccgcaccactggcagagctgaagctaccatcctggcggatatcgctcatcagttctggcatattccgcatgaaaaaatctggattgaagaccagtcaacaaactgcggtgaaaacgcacgctttagcatcgcgctattgaatcaggccgtagaacgagttcatacggctatcgttgttcaggaccccaccatgcagcggcgcacgatggcgacgttccgccgtataaccggggataatcccgatgcaccacgctggttaagttatcccggattcgttcctcagttaggaaataacgcagacagtgtaatctttgttaatccgttgcaaggattatggccggttgagcgttatctatcgctactcactggcgagctgccgcgtttacgcgatgatagcgatggctacggcccccgcgggcgagattttatcgttcacgttgattttccggcagaagtcatccaggcatggcaaacgctgaaacacgatgcggtgctcatcgaggcgatggaaagtcgctcgttacgttaaaaattgcccgtttgtgaaccacttgtttgcaaacgggcatgacttctgacttttatttctgcctttaattccttttacacttgtttttatgaagctcttcacagaattgtcctttcacgatgccgtctctctgataattgatgttaattaacaataaatttaccaaaaacaaacatacaaatcacaggagtcgcccatgtcagtacccgttcaacatcctatgtatatcgatggacagtttgttacctggcgtggagacgcatggattgatgtggtaaaccctgctacagaggctgtcatttcccgcattcccgatggtcaggccgaggatgcccgtaaggcaatcgatgcagcagaacgtgcacaaccagaatgggaagcgttgcctgctattgaacgcgccagttggttgcgcaaaatctccgccgggatccgggaacgtgccagtgaaatcagtgcgctgattgtcgaagaagggggcaagatccagcagctggctgaagtcgaagtggcttttactgcggactatatcgattatatggcggagtgggcacggcgttacgacggcgagattattcaaagcgatcgtccaggagaaaatatccttctgtttaaacgtgcgcttggcgtgactaccggcattctgccgtggaactttccgttcttcctcattgcccgcaaaatggctcccgctcttttgaccggtaataccatcgtcattaaacccagtgaatttacgccaaacaatgcgattgcattcgccaaaatcgttgatgaaataggccttccgcgcggcgtgtttaaccttgtgctcgggcgtggtgaaaccgttgggcaagaactggcgggtaacccaaaggtcgcaatggtcagtatgacaggcagcgtctctgcaggtgaaaagattatggcgactgcggcgaaaaacatcaccaaagtgtgcctggaattggggggtaaagcaccggctatcgtaatggacgatgccgatcttgaactggcagtcaaagccatcgttgattcacgcgtcattaatagtgggcaagtgtgtaactgtgcagaacgtgtttatgtacagaaaagcatttatgatcagttcgtcaatcggctgggtgaagcgatgcaggcggttcaatttggtaaccctgctgaacgcaacgacattgcgatgggaccgttgattaacgccgcggcgctggaaagggttgagcaaaaagtggcgcgcgcagtagaagaaggggcgagagtggcgttgggtggcaaagcggtagaggggaaaggatattattatccgccgacattgctgctggatgttcgccaggaaatgtcgattatgcatgaggaaacctttggcccggttctgccggtggtcgcatttgacacgctggaagaggctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgctggatggcgtaaatccggtattggcggcgcagatggtaaacatggcttgcatgaatatctgcagacccaggtggtttatttacagtcgtaatgagtgaaagaggcggaggttttttcctccgcctgtgcgcgtcagagtttagcgaatttttcgagggtgcgaataagctgcgtgacgaagccatattcgttatcgtaccaggcgaccgttttcaccagttgtaaatcgcccacggcggtaatttccgtttgcgtggcatcaaacaccgaaccgaaatggctgccaatgatatcggaagagactatttcttcatcggtataaccaaatgactcgttattgtttgtcgcctttttaagcgcgttgttcacctcttcggcagtcactttttttccgagaatcgacaccagttcagtgaccgaacctgttttcaccggcacgcgttgcgcatgacctttcagtttgccgctcaattccgggatcaccagaccaatggcttttgccgcccccgtagtgtggggaatgatattttctgccgctgcgcgtgaagcacgtaaatctttaccacgtgggccatccaccagtgactgggtgccggtataggcatgaatggtcgtcatcgtgccgacttctatcccgaaactgtcatgcaaggctttggtcatcggcgcaaggcagttagtggtgcatgacgccacggaaacaatggtgtcgttgccatccagagtgtcgtcattgacgttataaacgatggttttcatttcaccggcaggggcggaaatcaacaccttcttcgcgccagcatcaagatgcgcctgcgatttctcggcggaggtataaaagccagtacattcgacaatgatttctgcgcctttcgctttccacagaatatttttagcctctttttcggcgtaaaccgcgatacttttcccatcaacgataagtgaatcttccgtataatcaacgctccaggggaacggtccgtagtttgaatcatgtttcagcaggtaggcgagaatttttggggaagtgagatcattaatagcgacaacgtctatgttgcttttgacttcaagtaatcgacgcaacaccagtcgaccgatacgaccaaaaccattaataccaactttactcatggtcttctcctgtcaggaacgttcggatgaaaattgatcctttccaggcttagaccaggatggcgggatgggcaatctacattcttgcagtgaaacgtaacgtactgaaaacgggtgaacaatatttaatgaaattttaagaaaagcccgttatgttaacggcaaattatgttaaagcaggaaatgttatgggaaataaatactcaaggttacaaatcagcattcactggctggtctttttgctggttatcgtagcgtattgcgcaatggagtttcgtggtttcttcccacgtagcgatcggcccctcatcaacatgattcatgtttcctgtggcatctcaattctcgtactgatggtggttcgtcttttgttaaggctgaaatacccaaccccgccgattatacctaagccaaaaccgatgatgacgggactggcgcatttgggccatttggtgatttatctcctgtttattgcgctgccggtgattggtttggtgatgatgtataaccggggcaacccgtggtttgcgtttggtttgacgatgccttacgcttcagaggccaatttcgagcgggttgatagcttaaagtcgtggcatgaaacgctggcgaatctgggatattttgtcatcgggttgcacgctgcggctgcactggcacaccactatttctggaaggacaactcacttctacgcatgatgccacgtaaacgttcctgaaggatatttaaagaaaacgcctgtactaaaaccgacccgtggtacaggcgaagaatacgggcctacatcggaagcgcctattatatttatttgtatgacaaataaaaccataatccttgtctatacgtccatctggcttatctttaatcaattcacccgatctttgatctcatcaacggtatcaaaataaaccagcgtataacgttcaaatcgaacataagattcgataaatcatggaggttatatgaaaaaactggcacttatcctggttatgggaacgcttgtttccttttatgccgatgccgggcgcaaaccctgttctggttcgaaaggggggatctcacactgtacggcaggcggcaaatttgtctgtaatgatggttctattagtgcatcgaaaaaaacatgcactaactgaagtgtaaaaggggtgccatgagaaaatgaatccgctagtcagatgcgcggggaaaatccccgcgcttgcccttacctggacgtgcaggccatgagcgcagcaacttccttatcaccgtcccggaaccgcagttcgtagagcgattgtcgggtcagtgtgaatgtcagaatcgtgttactctcgcaaggccgtggatttgccgttgtcgccagcgaagtacggacactcgcaagccgcagcgctcaggcggcgaaagagattgaaggcttgatcagtgaatcagtcaggttaattgacctgggatcggatgaggtggcaacggcagggaaaaccatgtgcactattgttgatgccgtcgcgagtgtcacacatatcatgcaggaaatcgccaccgcctcggatgaacaaagtcgaggcataatgcaggttagccaggcgatttctgaaatggataaggtgacgcaacagaatgcttctctggtagaagaggcctcaacggcggcggtgtcccttgaagaacaggcggcacgactaactgaggcggtggacgtattccgtctgaacaaacattctgtgtcggcagaaccacgaggagctggtgaaccagttagttttgctacggtgtgaaaatgttaaaggagggatcgacagatcccttcacctttcagaacggcattgattttcgaatagcgttaatcatcaactggcaaccagaagagaacgtcgcatctacgcgggtcagtattccaatcggttcgcctgcaccatgtcccggaacaggcagggctaccagcgtggcatgacgcaggtcgtcttttacagcgccagaagggacaaaccacacgtaatcgtattcaaccgtaagttgacgagatagcgaagcagacagcgtttcgatacaacccgaaggaattttacatccctggctctgcactaatgcatctgaatgctggcgtggcgcagtgccttctggtgatacaacgaccggccattccagcacccggcttagcgttacgttctcctgaagtagcgggtgattggggcggacaaccagcttcagcgattcaagaaacagcagttcataattaagcccgttcatcagttcaggatctgacatccgaccaatgccgatatcgatttccccggtttttaaacccgccagaatcatagggttactcattgtcgcaacttgcaaggtcgtctctttttgttgctgatgaaactgacctataaccgaaggtaatatccctagtgccgcagtaggtagcgcaccaaccctgacgacatcattattaagaccttctttacgatgaagcgactgtccggcagtgttgatggcgtcaagaactctgactgcatgcgttaaaaattgttcgccgggtaaggtaagttgcgccccctgacgaccacgctcaaacaagcgagcgcccgtcagctgctccagttcattcaatgtcttagagagcgcaggttgactcaaattaagggtttcagccgcgcgccccaaagttccttgttgtgcgacagctacgaatgtatgaaggtggcgcaaacggatgcgctgactaaacagactatttttttccataagcgatgttaaaaacgaagcggtgtcgctgacaagtgaagttgttttattatgataacttgattgcaaaatattattaacaattaaagcaactatgttacagcaaaatggataatattgatgttttcgcggcgagatcacagtttgtaaattcttccagccggagtgaatgcggttacctacactccagattactgaccactggaggcagacactatggcgaacagcatcacggcggatgagattcgggaacagttttcgcaggcaatgtcagccatgtaccagcaagaagttccgcagtacggcacgctgctggaactggtagctgatgtaaatctggcggtgctggaaaacaatcctcaactgcacgaaaaaatggtaaatgcagacgagctggcgcgactgaatgttgaacgtcatggggcgattcgcgttgggactgcacaagagcttgctactcttcggcggatgtttgccattatggggatgtacccggtgagctattacgatctctcgcaggcaggggtgccggtacattcgacagcatttcggcccattgatgatgcttctctggcgcgtaatcccttccgcgtttttacctcgttactccgtcttgagcttatcgagaacgaaattttgcgccagaaagcggcggagattctgcgtcagcgcgatatcttcaccccatgttgtcgacaactgttagaggaatatgagcagcagggcggttttaacgaaacacaggcacaggagtttgtgcaggaagccctggaaacgtttcgctggcaccagtcagcaacggtagatgaagaaacctatcgcgccttgcacaacgaacatcggttgattgctgatgtggtctgttttcctggatgccatatcaaccatctgacgccacgtacgctggatattgaccgggtgcagtcgatgatgcctgaatgcggaattgaacccaaagttctgatcgaagggccgccgcgccgcgaggtgccgattttactacgccagaccagctttaaagcactggaagagacggtgttgtttgcggggcagaaacagggcacacataccgcgcgctttggtgaaattgagcagcgtggtgtggcattaacgccgaaagggcgacaactgtatgatgatcttctgcggagcgctggaaccgggcaggataatctcactcaccaaatgcatttacaggaaaccttccgcacttttcctgacagtgagtttttaatgcgtcagcaagggctgggatggttccggtaccgtctgacgccttcgggtgaggcgcatcgtcaggcgattcatcccggagacgatccacagcccttaatagaacgtggttgggtagtggcgcaacccattacctatgaagatttcttgcccgttagcgcggcggggatcttccagtcaaatctgggtaatgaaacgcaggcatgcaatcacggtgatgccagtcgcgaagcatttgagcaggcgttgggggggccggttttggatgagttccagctttatcaggaagcggaagaacgcagtaaacgtcgctgtggtttgctttaaattctgaccatccgcctttgcaaaaatttgcctgattttacaaacgaatcaggctcatcccatcgacataaaaaaaatgccaatttatgcatattctctgatttcaacaattggattattaataaatattgtctagagtgagcggtcataaataagcactttcttgccgctgaaaatgatcagcgcgggaccatttacaacaccagaaggactcactttcaggtatggatcgtagacgatttattaaaggttcaatggctatggccgccgtgtgcggtaccagcggcattgcttctcttttttctcaggcggcattcgcggccgattctgatattgccgacgggcaaacccagcgttttgacttctccattctacagtcaatggcgcacgacttagcgcaaacagcatggcgtggtgcaccacgtccgttacctgacactttggcgacaatgacgccgcaggcttataacagtattcaatacgacgccgaaaaatcgctctggcataacgttgaaaaccgtcaactggacgctcagtttttccatatgggaatgggattccgtcgccgcgttcgtatgttttctgtagatccagcaacacatctggcgcgtgaaattcactttcgcccggagttgttcaaatacaacgatgcgggtgtggataccaaacaattagaagggcaaagcgatctcggttttgccggttttcgcgtgtttaaagcccccgaactggcgcgccgtgatgtagtatcattcctcggcgcgagttatttccgcgccgttgatgacacatatcaatacggtttgtcggcccgcggcctggcgatcgacacttacaccgacagcaaagaagagttccccgactttaccgccttctggtttgatacggtaaaaccaggggcaaccacctttaccgtttatgcgttgctcgatagcgccagcattactggtgcctataagttcactatccattgtgagaaaaatcaggtgattatggatgtggaaaatcacctgtatgcgcgcaaagacattaaacagctgggcattgcaccgatgaccagtatgttcagctgcggtactaatgaacgtcggatgtgcgacaccattcatccgcaaatccatgactctgatcgtctgtccatgtggcggggcaacggcgagtggatttgccgtccgctgaacaatccgcaaaaattgcagttcaatgcttacaccgacaacaacccgaaagggtttggtttattgcaactggatcgtgatttctcccattatcaggacattatgggctggtataacaaacgcccaagtctgtgggtggaaccgcgtaacaagtggggtaagggcaccatcggcctgatggaaatcccaacaacgggcgaaacgctggataacattgtctgcttctggcagccagaaaaagctgtaaaagcgggtgatgagtttgcattccagtatcgtctgtactggagtgcgcaaccgcctgttcattgcccattagcgcgcgttatggcgacgcgtaccggcatgggcggtttcccggaaggttgggcgccaggtgaacactatcccgaaaaatgggcgcgacgttttgccgtcgatttcgttggtggtgatctgaaagctgccgcgccaaaaggcattgagccggtgattacgctttccagtggggaagcgaagcaaatcgaaattctctatattgaacccattgatggttatcgtattcagtttgactggtatccgacttcggactccactgatccggtcgatatgcggatgtatctgcgttgtcagggcgacgctatcagtgaaacatggctctatcagtatttcccgccagcgccggataaacgtcagtatgttgatgaccgcgtgatgagttaatcgttttttcttcggcatcttcttcgggaggtgccgtctggttaaacacgatcccgctcgcatttttccctaagttaaatgagtaatctgatggtgtgtatttcagatacaccttgtcagccactaacagggagtgcgtatgtttccagaataccgagatttaatatcccgtctgaaaaacgaaaatcctcgctttatgtccttgttcgataaacacaataaacttgatcatgaaattgccagaaaagaaggttccgacggtcgagggtacaatgcggaagtggtccgcatgaaaaaacaaaagctacagttaaaagatgagatgctcaaaatcctgcagcaggtgagcgtcaaagaggtgtaaactttcctaagccgccagccaggcggcttttttaacagctgcatggattgactggagataagatgactgaaacgataaaagtaagcgaatcacttgaattacatgctgttgcggaaagtcatgtcacacctctttatcagttaatctgtaaaaataaaacctggttacagcagtcgctaaactggccgcagtttgttcaaagtgaagaggacacgcgaaaaacggtgcagggtaatgtgatgttgcatcaacgcggctatgccaaaatgttcatgattttcaaagaagatgaacttatcggcgttatctcttttaatcgtattgaaccactgaataaaaccgctgaaatcggctactggctcgacgaatctcatcaggggcaggggatcatttctcaggcgctgcaggcattgattcatcattacgctcagtctggtgaacttagacgcttcgtgatcaaatgtcgggtggacaatgcgcaaagcaaccaggtcgctttgcgcaatggttttatccttgaaggttgcctgaaacaggctgagttcctgaatgatgcctatgatgatgtgaacttatacgcgcgtattatcgattcacaataaccctgccaacggcgttcgagtaatgcgctcctcgccgttaatgacttttggaccacggacatgaaccgtgtcgccatcaaaggcttcaacgacggcgtggtcggttaactccacatggttttcaattatcaccgcaccagtaatacggctctcaccttgtatgacaacgtgctcgtcgagcagaatcggtccgccgcataccacggcatttccgccaatcaagacatgatgttttaacacacaattaccttccacaatggcatattccgccacctgcgaactgtaatgaatcgtcggaatggcatcttcttctatgccagctttcacctgcgcgtgaccgtagactttagcgcaatcgcatagccagacgttgttctcttcattaccttcaacgctggcaaaatcaaaaacttcggcgcgatgttcaataaaagcataccgggcgacggcatcgccataaatttgtgcctggtggacaatacgcgaggcgctaacctttgcgcgatcataaatttgtagcaggagttgatggtcgggcgttaagccttgtgcggcgacgatcatagaatgttgatcaattaaggcgtgaccaaatattctacattgaccacaaactaatgagtcacgaatggtgacactgtcacttatatatgcaccctggctgatttcactattatcgatccagacattatccgttgcgtaaacctctccccacagcacgctggtgccggtgatacgcgtattcccggaaatcaccgttccgccgaacgcaatagcattctggtcgtaaatccagcaatttccttcctgtgctaacaccgtttcgtgatcgatccagccgccagcgcttcctgctatcacatcgttaaaatcgctcatggcgataatttgccgtaataacacactttttttagtgccatcttcctgataactaaaggctcgctgttcttcacttagacgatatttacgcatagcgttttcccacaggtgacttactataaccgtagcaaattctgcggctctggctatgctcgagaaaattccataaaatgcatttcaaatatactttataaattaaacaaaatgagtaagaagatgcagagcgataaagtgctcaatttgccggcaggctactttggtattgtgttggggacgatagggatgggatttgcctggcgctatgccagccaggtttggcaggtcagccactggttgggtgatgggctggtgattctggcgatgatcatctggggattattgactggcgcatttattacccgactcatacgctttccgcatagcgtgctggcagaagtgcgccatccagtgctgagcagttttgtgagtttgtttccggcaacgacgatgctggtggcgattggttttgttccgtggtttcgcccactggcggtgtgcctgttcagttttggtgtcgtggtgcaactggcttatgccgcctggcaaactgcgggattatggcgcggatctcaccctgaagaagctaccacgcctggactgtatctgccgacagttgccaacaactttatcagcgcaatggcctgtggtgcgttgggctacaccgacgccggtctggtgtttttaggcgcaggcgttttctcatggctaagccttgaaccggtgatcttgcagcgtctgcgcagttcgggagaattacccacggcactgcggacatcactcggcattcagctcgctcctgcgctggtggcctgtagtgcctggctgagcgtcaacggcggcgagggtgacacgctggcgaaaatgcttttcggttatggactgctgcaactgctgtttatgctacgtctgatgccatggtatctctcccagccatttaatgcatcattctggagtttctcgttcggcgtatctgcactggcaaccaccggtttgcatctggggagtggcagcgataatggatttttccatacgctggcggtgccgctgtttatctttaccaattttattattgcaatactgctcatccgtacttttgcgcttctgatgcagggaaaattgttaatcagaaccgagcgcgccgttttaatgaaagcagaggacaaagaatgatcattcgtgacgaaaactattttactgataaatatgaattaactcgcacacactctgaagtactggaagcggtgaaagtggttaaaccgggtaaaacgctggatctgggctgtggcaatggtcgtaacagtctctacctggcagccaatggttatgatgttgacgcatgggataaaaatgccatgagtatcgccaacgtcgagcgcattaaatccattgaaaatctggataatttacacacacgggtcgttgatctgaataacctcacatttgatgggaaatacgattttattctttcgactgtggtgctgatgttccttgaggctaaaaccatcccagggctgattgccaatatgcaacgttgcacgaaacctggtggttacaacctgattgtggcggcgatggataccgctgattatccatgtaccgtcggcttcccgtttgccctcaaagagggagaattacgtcgatattacgaaggctgggagagggtgaaatacaatgaggacgtcggcgaactgcaccgcaccgacgccaacggtaatcgtattaaactgcgtttcgccacgatgctggcacgtaaaaaatgacccggtaagaacaaagcgcgtgaaaattccccacgctgagatggtttactgttcttcttttcggtaagcatattttttatcgaagggatgtgaaattaatcacagtagtcgaagttttttagccgcttaacttactgaaatttaactactgatgattgacttagcccctttttcggcattgactatgtcgtctgaaaaggggctaaaaaatttattttcaccaacactttttttgccacaacacgaagcggcgctttttgctataacttagaaagtaatataatcatctcaggaaactattcatgcgtaccacatcatttgcgaaagttgcagctttatgcggcttgttggctctgtctggttgtgcctctaaaatcacccagccagataaatattctggttttttaaacaattactctgatttaaaagaaacaacctcggcaacaggtaaacctgttttacgttgggtagatccgagttttgatcaaagcaaatatgacagcatcgtctggaacccaatcacttattatccggtaccgaaaccttctacccaggtagggcagaaagttctggataaaattttgaactataccaacaccgaaatgaaagaagcgatagcgcagcgtaaaccactggttaccaccgctgggccgcgtagtctgattttccgtggggccattaccggtgtagataccagtaaagaagggctgcaattctatgaagtggttcctgttgcattagtggttgcggggacgcaaatggctacaggccaccgtaccatggatactcgcttgtattttgaaggtgagctgattgatgcagcgactaataaaccggttatcaaggtcgttcgtcagggcgaaggtaaagacctgaataacgaaagtacgccaatggctttcgaaaatattaaacaagttattgatgacatggcgaccgatgccaccatgtttgacgttaacaaaaagtagttccagacgcgccatcgttagatggcgctttttattatcggtttctgttagcgattaaattcaacaccacgtaacaaacgcctccggcaattaatccccaaaacgcagaaccaatcccgaacagcgtcaatccacttgccgttaccagaaatgccaccaccgccgcgtcgcgctcacgctcattatgcagcgcctgatacaaactgccgccaatggtactcaacagcgcaagacctgccagcatctggatccaacttacgggcagggcagccatcatcccggtaatggcactaccaaacagacctgcgatcaaataaaaaataccagcaacggcagcggccagccaacgttgatctttatccggatgcgcttccgggctttggcaaatagccgcggtgattgccgcaataccgacggaataaacgccgaaaggggaaaaaacaagcgccagcaatccagtaaacacaatcaacggcgaaacaggagccgaatacccggctgctttcattgctgcgatacccggtgcgttttgcgatgccatcgtcaccagaaaaagggggagtgcaacgctcagactgtgagcaaacgaaaaatcagggggaatataagtggggagaacgggtttaaagacaacatcagttgtgacaacgtcaccttgcgcgataacgatcacgatcccaataatcatcgcggcaattaccgcatagcgcggcgcaacggccctggttgccagccataccagcaacatactgccacacaacgtaaattgaccatccagactggcaaacgcctgtaaaccaaaacgtaataaaatcccggcaagcattgccgccgcaagcgagtgcggaataatgcgcatcagacgagcaaagagtcccgttatgccgcagaggactattaacacgttggtgacaataaaaacgccgatggcttcgttaagtgttagtccctgtaatccggtgaccaacaaagccgcgccaggcgttgaccatgcggtgagaacaggtacgcgataccataatgtcagagtcagcgtactgacgcccattgccagccccagcgccgtcatccagccagagatttgtgcagtggtggctccggcgacaatcgctgcttgccagattattgccgctgaactggcgtagccaattaataccgccagaaaccccgccagtagcgtgggtggaggaatagaaaacagacgcatagtcacctcgtgcgttataacgtacggctaacgtagcatttgtccgttataacgcacaagtgataaacttccgttttgccggaggagtcgcatggaaaatctcgctcgctttttatccaccacacttaaacaactacgtcagcagcgcggctggagtctttcgcgactggcagaagcgacgggcgtttctaaagcgatgttagggcagattgagcgtaatgaatccagcccgacggtcgcgacattatggaaaattgccaccgggttgaacgtgccattttcaacatttatttctccgccgcagtcctctacaccttcagtttatgatccacaacggcaggcgatggtgatcacttcgctgtttccttatgatccacaactctgctttgaacacttctcgattcagatggcacccggtgcaataagcgaatcgacgccccatgaaaagggggtaatcgaacatgtcttcgtcattgatggacaacttgatctgtgtgttgatggtgaatggcagagccttaattgtggggaaggcgttcgatttgctgcagacgtcacgcatgtctatcgtaatggtggggagcaaaccgtacattttcattccctcatccattacccgcgcagttaagcgggaaaactatttcgcaacgtcgcgcttgtggctaaaatagccgccatttttcagctactggataagaaagtgaccgtatcttctcatcgtcttgaactgttaagcccggcacgcgatgccgccattgcccgcgaagctattttgcacggtgccgatgctgtttatatcggcggccctggttttggtgcccgtcataatgccagtaatagcctgaaagatattgccgagttggtgccgtttgcccatcgttatggtgcaaaaattttcgtcacgcttaacaccattttgcatgatgatgagctggaacccgcgcaacggctgattactgacctctaccagaccggtgtcgatgcgctgattgttcaggatatggggattctggaacttgatattccgccgattgaactgcacgccagtacgcagtgcgatattcgtacagtagaaaaagcgaagttcctctctgatgttggcttcacgcagattgtgctggcgcgagagctaaatcttgagcagatccgcgcgattcaccaggctacggacgcgaccattgaattctttattcatggcgcattgtgcgtggcctattcgggtcagtgctacatttctcatgcgcaaacagggcgtagcgccaatcgtggcgattgctcgcaggcgtgccgtttgccatacacattgaaagacgatcaggggcgtgtggtttcctatgaaaaacatctgctgtcgatgaaagataacgatcagactgccaacctcggcgcgctgattgatgctggcgtacgctccttcaagattgaagggcgttacaaagatatgagctacgtgaagaatatcaccgcccattatcgtcagatgctggatgccattattgaagaacgtggcgatctggcgcgcgcttcatcaggtcgtactgaacatttctttgttccatcgacggaaaagactttccaccgtggtagcacagattattttgtgaatgcccgtaaaggcgatattggcgcgttcgattcgccgaaatttatcggcctgccggtgggcgaagtattgaaagtagcgaaagatcatctcgatgttgccgttaccgagccactggcaaatggcgatggcctgaacgtgatgattaaacgtgaagtcgtcggttttcgtgccaatacggtagagaaaaccggagaaaatcagtaccgcgtctggcccaatgaaatgccagcagatttgcacaaaattcgcccgcatcacccactaaaccgaaatcttgatcataactggcagcaggcactgacaaaaacctccagcgaacgccgggtggcggtagacattgaactgggcggctggcaggaacaactgattctgaccctcaccagtgaagagggtgtcagcatcacacatacgctggacgggcagttcgacgaagccaataacgccgaaaaagcaatgaacaatctgaaggatggtctggcaaaactggggcaaaccatctattacgcccgcaatgtgcaaattaatttgccgggggcgctgtttgtaccaaacagtctgttaaaccagttccgccgtgaagccgccgatatgcttgatgctgcgcgtcttgtcagttaccagcgcggcagccgtaaaccggttgctgatcctgcgccggtttatccgcaaacgcatctgagtttcctcgcgaacgtatacaaccagaaagcgcgtgaattttatcatcgctatggtgtgcaactgattgacgcggcgtatgaggcacatgaagagaagggcgaagtcccggtgatgatcaccaagcattgtctgcgctttgccttcaatctgtgcccgaaacaggcgaaaggcaatatcaaaagctggaaggcgacgccaatgcaactggttaacggcgatgaagtattaacgctaaagtttgattgccgcccatgcgagatgcacgtcattggcaaaatcaaaaatcacatactgaaaatgccgttaccgggaagcgtagtggcatccgtaagtccggatgatctgctgaaaacattgccgaagcgaaaagggtaaaacgccagttttcgggttactcaccactcatcaaatctgcatgatattgcctgccgggtaaggcgtcatgccgcatccggcaacaaatgactcaacgctgtcccgcttctggtttgcgcgatttttgccagtaaaaatgctcgcgcaaaccttccgccgactcttccgccacagcacgcaattcatcgctgtccgcttcatgacgcagctgatgatccacattctttacccacataaattcatgtcctttgtgccctgccatgagttgtcctgagaacagtgcacacgttaataagacaaccgataacgccttcgaaaacatcccgccacctttttctaaccttttgccgctatgatgccgatcgtttcttgaggttattattcagttttgcaaattagagcaaagaaattctggaatcttccttcctgattttgcattgcattctgccgttgcggcgatttagtgctattttcgagcacattacacacggaggtaaacttcgccattaaatagtcacgatcactttattgaagtgcctttgagcgtcgcctctaaggtattgctgttaaatgcttttttacagtcagaaatcactcagcaagagttagccaggcgaattggcaaacataaacaggagattactcgcctatttaatttgcaccatgtgacaaaaatcgacgccgtccagctcgcggctaatgcgcttggcaaagagttatcgctggtgatggtttaattacagttaacgaaaagttgtcatttttaacaactgatatagactgccgaatcatctgcacataattacgattcgataatgaaaaaataccagcagcttgcagaacaattacgcgagcagattgcgtcgggtatctggcaacccggcgatcgtttgccttcgttgcgtgaccaggtggcgctttctggcatgagctttatgactgtcagccatgcctatcagttgctcgaaagtcagggatatattatcgcgcgaccgcaatcgggttattacgttgcgccacaggcaataaaaatgccgaaagcgacagtcattccagtcacacgagatgaagcagtcgatatcaacacctatatttttgatatgttgcaggccagtcgcgatccgtcggtagttccgtttgcctcggcctttcccgacccgcgacttttccccctccaacaactaaaccgctcgctggcgcaggtaagcaaaaccgccacggcgatgagcgtgattgaaaacttaccgccaggaaacgtagaactgcgtcaggctattgctcgtcgctatgccttacagggcatcaccatttctcctgatgaaattgtcattaccgccggggcgttagaggcattaaacctcagtttgcaagcggtaactgaaccgggctattgggtgatagtagagaatccttgtttctacggcgcgttgcaggcgctggagcggttacggctgaaggcgttatcggtagcgacggatattaaagaagggatcgatcttcaggcgctggaactggcgttgcaggagtatccggtgaaagcgtgctggctgatgactaatagccagaacccacttggatttaccttaacgccgcagaaaaaagtgcggctggtagcgttgctcaatcagtacaacgtaacgctgattgaagatgacgtttatagcgaactttattttggacgggaaaaaccgctgcctgcgaaagcgtgggatcgccacgatggtgttttgcattgctcttcgttttcgaaatgtctggtgcctggttttcgtattggttgggtcgccgccggaaaacatgcacgtaaaattcaacgcttgcagttgatgagtacgctttccaccagctcaccgatgcagcttgcgctggtggattacctttctactcgccgatacgatgctcatcttcgtcgtctgcgtcgccagcttgcggaacgtaaacaacacgcctggcaggctttgctgcgttatctgcctgcggaagtcaaaattcatcacaatgacagcggttattttctctggctggagctccccgagccgttagatgcaggagaattaagcctggtggcactgacgcatcatatcagtattgcgccgggtaatatgttttctaccggtgaaaactggtcacgtttttttcgttttaataccgcgtggcagtggggagaacgtgaagaacaggcggtaaaacaattaggcaaacttattcaagaacggctgtaatagcgtttaatttaattcctctcaggttgggtaatatgaatttcgaatagcagtcatatatcctaactccttgtctatactccagaagataaccttacagacggcataatgcgcggtagctcacaacctgattaaattttctcagggccgaaggtgtgcctgcaagccgccgtctatggttaaacaaggagatatttttacggcacggcggctgaacaattaattacgacaggagtaagaccttatgagcaagacatttgcccgcagcagcctgtgtgcgctcagcatgacaataatgaccgctcacgccgccgaaccgcctaccaatttagagaatccggaagggcgactggatattatcgcctggccgggatacatcgaacgcggacaaactgataaacagtacgactgggtaacgcaattcgaaaaagagacaggctgcgcggtgaatgttaaaaccgccgcgacttccgatgaaatggtcagtctgatggccaaagggggttacgatctggttacggcatccggcgatgcctcgctgcgtttgattatgggcaaacgcgtgcagccaattaataccgccttgattcccaactggaaagcgctcgatccgcgcgtggttaaaggcgactggtttaacgttggcggcaaagtttacggcacaccttaccaatgggggccgaacctgctgatgtacaacactaaaaccttcccgacgccgccggatagctggcaagtggtttttgttgagcagaatctgccggacggcaagagcaataaaggccgggtacaggcttatgatggccctatctacattgcggatgccgcgttgttcgtcaaagccacgcagccacagttgggcatcagtgatccgtatcaactcaccgaagaacagtatcaggcggtgctgaaagtgctgcgcgatcaacataatttgatccatcgctactggcatgacactaccgtgcaaatgagcgatttcaaaaacgagggtgtggtggcttccagtgcatggccctatcaggccaacgccctgaaagccgaaggccagcctgtcgctaccgttttcccgaaggagggcgttaccggttgggctgacaccaccatgctacatagcgaagcgaaacatccggtttgcgcctacaaatggatgaactggtcattaaccccaaaagtgcagggcgatgtggcggcctggtttggctcgctaccagtagtgccgcaagggtgtaaagccagtccgttattaggcgagaaaggttgtgaaacaaacggttttaactatttcgataaaatcgccttctggaaaacgcctatagcagaagggggcaagtttgttccctacagtcgctggacgcaggattacattgccattatgggcggtcgctaacttcgttggggtgttttatgacgtacgcagtggagtttgacaacgtctcacggttgtacggtgacgtgcgcgcagtagatggcgtcagtattgcgataaaagatggtgagttcttctctatgctggggccgtccggctccggcaaaaccacttgcctgcgcctgattgctggattcgaacagctttccggcggggctatctctatttttggtacgcccgccagcaatctgccaccgtgggagcgggacgtgaatactgtcttccaggactacgcgctatttccgcatatgtcgattcttgacaacgtagcctacgggctgatggtcaaaggcgtgaataaaaagcagcggcacgcaatggcgcaagaggcgcttgagaaagtggcgttggggtttgtacagcaacgtaaaccgtcacaactttctggtggtcagcgccagcgagtcgccatcgccagagcactggtgaacgaaccgcgtgtgttgttgctggatgaaccgctcggcgcgctggatctcaaattgcgcgagcaaatgcagcttgagctgaaaaagctgcaacagtctctcggtatcacttttatcttcgttacccacgatcagggcgaagcgttatcgatgtccgatcgggtggcggttttcaataatggacgcattgaacaggtcgattccccgcgtgatctctatatgcgcccgcgcacgccgtttgttgcgggattcgttgggacatcgaatgtttttgatggactgatggcagagaaactttgtggcatgacgggaagcttcgcactacgaccggaacatatccgcctcaacacccctggagaaatgcaggctaatggcacgatccaggcggtgcagtatcagggcgcagcgacccgttttgaactgacactgagcggcggtgaaaaactgctggtgagtcaggccaatatgacaggcgaagagctgcctgccacgctcacgcccggacaacaggtgatggtttcctggtcgcgtgatgtgatggtggcgctggttgaggagaggtgaatggcgatgaacgtattgcaatcaccttcacgtccaggtctgggtaaggtgtccggtttcttctggcgtaatccggggctggggctgtttttgctgctgcttggcccgctaatgtggtttggcattgtctatttcggctcgctgctgacgctgttgtggcagggcttttatacctttgacgatttcaccatgtcggtaacgccggaactgacgctggcgaatatccgtgcgctgtttaatccggcgaattacgacatcattctccgcacgctgaccatggctgtggcagtcactatcgccagcgccattctggcttttccaatggcgtggtatatggcgcgctataccagcggaaaaatgaaagcgtttttttatatcgcggtaatgttgccgatgtgggcgagctacattgttaaagcctatgcctggacgttattgctggcaaaagatggcgtggcgcagtggtttttacaacatctggggctggaaccactgctgactgcgttcctcacgctaccggcggtgggaggtaatacgctgtcaacttccgggctggggcgctttctggtgtttctctatatctggttgccgttcatgatcctcccggtgcaggcggcgcttgagcgtttgccgccgtcattgttgcaggcgtcggctgatcttggcgcacgtccacgacaaacctttcgctatgtggtgctgccgctggcaatcccgggtattgccgctggctctatctttaccttctcactcacgctgggcgattttattgtcccgcagctggttggccctccaggatattttatcggcaatatggtttattcccagcagggggcgattggcaatatgccgatggcggcggcattcaccctggtgccgattgttcttatcgcactgtacctggcgttcgtgaaacgtctgggagcgttcgatgcactctgatcgcgcaccgtttttcctcaaactggcggcctggggcggcgttgttttcctacattttcccatcctgataatcgccgcctatgcgtttaacactgaagatgcggcgtttagttttccaccgcagggcctgacgctgcgctggtttagcgtggcagcacagcgtagtgatattcttgattccgtgacactgtcacttaaagtggcggcgctggcgacattaatcgcgctggtgttagggacgctggccgctgccgcgctgtggcgacgagactttttcggtaaaaacgccatttcgttgttactgctgctgcccattgcgctgccgggcattgtcactggtctggcgctattaaccgcctttaaaaccatcaatctggagccgggatttttcaccatcgtggtcggtcatgcgactttttgcgtagtggtggtgtttaacaatgtcatcgcccgttttcgccgcacctcgtggagtctggttgaggcgtcaatggatcttggggccaatggctggcaaaccttccgctacgtagtgttgccgaatctcagttcggcgttactggctggaggaatgctggcgtttgccttgtcgttcgatgaaatcatcgtgacgacatttacggcaggtcatgaacgaacgttaccgttgtggttgctcaatcagcttgggcgaccgcgtgatgtaccggtaaccaacgtggtggcactgctggttatgttggtaacaaccttgccgatcctgggggcctggtggctaacccgcgaaggcgacaatggtcaataaccactgatacaggaatatgctatgcaacataagttactgattaacggagaactggttagcggcgaaggggaaaaacagcctgtctataatccggcaacgggggacgttttactggagattgccgaggcatccgcagagcaggtcaatgctgctgttcgcgcggcagatgcagcatttgccgaatgggggcaaaccacgccaaaagcgcgtgcggaatgcctgctgaaactggctgatgttatcgaagaaaatggtcaggtttttgccgaactggagtcccgtaattgtggcaaaccgctgcatagtgcgttcaatgatgaaattccggcgattgtcgatgtctttcgctttttcgccggtgcggcgcgctgcctgaatggtctggcggcaggtgaatatcttgaaggtcatacttcgatgatccgtcgcgatccgttgggggtcgtggcttctatcgcaccgtggaattatccgctgatgatggctgcgtggaaactggctccggcgctggcggcagggaactgcgtagtgcttaaaccatcagaaattaccccgctgaccgcgttgaagttggcagagctggcgaaagatatcttcccggctggcgtgattaacgtgctgtttggcagaggcaaaacggtgggagatccgctgaccggacatcccaaagtgcggatggtgtcgctgacgggttctatcgccactggggaacacatcatcagccataccgcgccgtccattaagcgtactcatatggaacttggtggcaaagcgccagtgattgtttttgatgatgcggatattgaagcagtggtcgaaggtgtacgtacttttggctattacaatgccggacaggattgtactgcggcttgtcggatctacgcgcaaaaaggcatttacgatacgctggtggaaaaactcggtgctgcggtggcaacgttaaaatcgggttcgccggatgacgagtctacggagcttggacctttaagctcgctggcgcatctcgaacgcgtcagcaaggcggtagaagaggcgaaagcgacagggcacatcaaagtgatcactggcggtgaaaagcgcaagggtaatggctattactatgcgccgacgctgctggctggcgcattacaggacgatgccatcgtgcaaaaagaggtatttggtccggtagtgagtgttacgctcttcgacaacgaagaacaggtggtgaactgggcgaatgacagtcagtacggacttgcatcttcggtatggacgaaggatgtgggcagggcgcatcgcgtcagcgcgcggctgcaatatggttgtacctgggtcaatacccatttcatgctggtaagtgaaatgccgcacggtgggcagaaactttctggttacggcaaggatatgtcactttatgggctggaggattacaccgtcgtccgccacgtcatggttaaacattaaggataatattgcagatcgtaagagtatgagatgatcttgcgtactgtcagagcactgatttctctgacagtacgtgctgcgtgcaaaatcacaacatcaaataaaccagccaaatctcatagagataagagtaaacaaaccaacagcagcaaagacatttatcagtactacagttctactggaaacattcatttttgccaccttttatcattgcccctatgtgtgtatagtacgggttaagaaaatccgcaataatactcattctgaagatagataagggcaagttgctgtttgatgattttttctctaactggtgaaaaaacttgatgcacgtcaaaaaatgacgcatatttgcgcgcgttttattcatctggctggacgcccgtacatgtctctctatcaacatatgcttgttttttatgcggttatggcagcaatcgcatttcttatcacctggtttctttctcacgataagaaacgcatccgtttcttaagcgcctttctggtgggggcaacatggccgatgagtttcccggtggcgctgttgttttctctgttttaaatcttatgcactggcttgacggcaccacgcagacttatatcatttggatgaatcgataaatttcacaagtggctaaggagaaagtatgtcgcatctggatgaagtcatcgcgcgcgtggatgccgcgattgaagagagcgtcattgcccatatgaacgaattattaatcgccctgagcgatgacgcggagttaagtcgggaagatcgctacacccagcagcagcgtttgcgcaccgctattgctcatcacggtcgcaaacataaagaagatatggaagcgcgccacgaacagttaaccaaaggcggtaccatcctctgattaaaatgagcgtctggccaccagccaggcgccaaccacaagtaaaattgcgccacaaattgggccgatcaacgcccgaagtggtacgccatggctgcggaagatatccagcaccagaccgccaatcagctggctggcgaccagtactgcaatagttgtcgccgctcccacattctgatatccgctgatactggcgaagacaaaaaacgatcccagcaagccaggtataagtgtccaccagcgcacgctggacaccagttcgccaaaccccgccatgccttgtttaaaccataaaatagaaacaaagagcacaatccccaccagtgagttcagcaacatggcgatgagaatggtagaggaggtctgggtgatgcgcaccatcagcgtgttctggactaccagaccaatcccggctgcaatcaaaaaggcaagggtaagtgactgattcatccgatcgcgtccggttcagtgcgctcgtcgagttgcaactgcataaatgtcagatccagccagcgcccaaatttagtacctacctgcggcatttgcgcggtgacgacaaatcccagcgactggtgcagatgcagcgaggcctgattttgcgattcgatcccggcgaccatgacatgcttcccgcaatcccgcgcttcatcaatcaatcggcttaacaatttacgccccagacctttcccctgatgatcgggatggacataaaccgaatgttccacggtatggcgaaaaccatcaaaactacgccagtcgccaaacgaggcatatcccgtcactacgccatcttcttcactcaccagcaccggataacctgctatggtccgcgcttcaaaccaggcaatgcggttatccgcatccaccgtttggtcattccagatagccgccgtatacaacacggcgtggttataaatttccgcaattgcagcacagtcggctttgcgggcaaaacggatggacatgtctggcctcgataaaataatgatgatgatgttatcaatactatcgaaaacagcccgaagcaacggattcctctatgaaattattgcgtgttgcagaggggatgtgacggctgcaaacaaaaccaatcctgtgagcctgctacactattgatggattcatgccaaaagcacaggagagcattatggggcaacaaacgcagcgtaaccgatgttgggttctgtccttgcgtccgcatggcgcgccggttccttacgtctggtttcggtaaatgcgctctttgtcgcaccagcgcaagcatttacagttccggaagtgggaaaacgtcaattaaatgaaatcaatcggatccgctacgaactggaattaatggcagttgctctggctgtcgaaaacctcactatgcaaaaaaacgttgctttgttgtgccaacaatacagccgataaataaaatacgcccggcaaataccgggcttaaagataattactcaaatcgccacgcaatatttatgccgacaccataatttcgtccgggcgcaggttcgtaatatcgcccgtttgactcattgacaatgacagagccaacgtattctttatcgaataaattatcgacacgaccaaataaatccacggtaaaattgtggtaattgtatttatacccggtgaataagccgacgagtgtataagaaggcgctttggccgtattttcatcatctgccataatatcgcccatataacgcgcttccgtgcctgcataccaaccatcttccggtatataacctatcgacgcaaagcccatattacgggcgatccctggcatccggttaccgttacaatcctgttcattgcacacattgctgcgataggtcgcatcaagccaggtccaggacgcttttacgcgaaaatctcccgcgaaacgttgatcccatgccagttcagcgccttgacgacgggtctttccggcatttttgtaagtcgtacgcccaccgctactgctatcgacaacaatttcatcatcggtgtcggtctggaacaatgcgagactaagcagcccatcaccaatacgcgttttactgccgatctcaattgtatcgttggtggagggttttaacccaaagttcataccgctttgtccatcagcacgataagacagctcattaatcgtcggcgtttcaaaacctcgcccggctgccagatagatattccaggcatcggtcattgcatattttaacgaaccggcaggtagccatttgtgataactggcatcaccgctgtcatcgccgttacccggagtaacgtaatggtcgttggaatcaaaccacacggagctgtagcgcacgccagcatccagcgacagtttttcgctcagctgccactgcgtctgtaaatagggatcgacgttccacatcagattgcgttcgtcgcggcgcaactcacctttttgcccgtattccggcacgccgctattcaggcggaagttattgtagcccttgcggttttcactcatgttttcgtagttcaggccggtagtgaacgtgagcggaacgcccagttcaccacggtgtgtccagcggctgtctatcccctgataatggcgttgcagagtaatcacgccgcccgcatgtgacgggttaagttggggagccatcgggattgactggtactgggtcgtttctcgctctccggcatacatcatcacactcatatcatcttgcgcgctcaggctacgctcatagcgcaacccagcctgagtttgcttgatggtttttcgcgtgtcgtactgttctgcacgaggcgcttgttgtggattcgccttccattctgctttggttagcccacctgggtcatctgctttgatatccacactattgaaaatcaggcttaatttgctggcgtcatcaatgcgtacgcccagtttggcattggctaaatttttctgtgcgccgctatggtcacgatagccgtgggtagtaaaacgtgtggttgagacggtgtaatcgacatcgccgggttgtgtgccgtcgcccgttgcgcccgtagctttcagcccatagcgccagctgccaaaactgccgtagtaactactggcttcaatggttggtggctgttgtccggtctgggtggtgacattcattacaccgccagacgcgttgccatacagagcagagaaggggccacgcagcacttccacattttgcacactgcttaaatcgatgttagatgtttgcccttgtccgtcgggcatggtagcgggaataccgtccacatacaggcgaataccgcgaattccgtaagtggagcgggagccaaatccgcgaatcgacagctgtaaatcttgcgcatagttctgccggttttgtacctgtaaaccaggcactccggtcagtgattcagacaagttaatgcgcggtgttgccaggcgcatctcctcgccattcaccacgctcacggctgctggggtatccagttctgaaaccacctgcggtgcggcactgacaatcatggtctgttcatcagcggcaaaaacaacgggggaaaggacaagcagtgcgggcaaaacggtctgtcggacggaaaaaatcttcatgaaaaaagccaggttaagaatgggaaaacaccgtcatggtaatgaaattgtaaatttatggaaaactaaacggcacaatacgttaagtaattgagaaaattgtagtcgtaacggtaagaaatgctccacatttgagaaaataatgattaccattcccatttataacaagggcgtaacgatgattacgcttagcgaagcattgtgaagcagcaaaaatatcggttcatcaaagggagtcgtcatgcatttacgtcatctgttttcatcgcgcctgcgtggttcattactgttaggttcattgcttgttgcttcatcattcagtacgcaggccgcagaagaaatgctgcgtaaagcggtaggtaaaggtgcctacgaaatggcttatagccagcaagaaaacgcgctgtggcttgccacttcgcaaagccgcaaactggataaaggcggcgtggtttatcgtcttgatccggttactctggaagtgacgcaggcgatccataacgatctcaagccgtttggtgccaccatcaataacacgactcagacgttgtggtttggtaacaccgtaaatagtgcggtcacggcgatagatgccaaaacgggcgaagtgaaaggtcgtctggtgctggatgatcgtaagcgcacggaagaggtacgcccgttgcaaccacgtgagctggtagctgatgatgccacgaacaccgtttacatcagtggtattggtaaagagagcgtgatttgggtcgttgatggcgagaatatcaaactgaaaaccgccatccagaacaccggtaaaatgagtaccggtctggcgctggatagcaaaggcaaacgtctttacaccactaacgctgacggcgaattgattaccatcgacaccgccgacaataaaatcctcagccgtaaaaagctgctggatgacggcaaagagcacttctttatcaacatcagccttgataccaccaggcagcgtgcatttatcaccgattctaaagcggcagaagtgttagtggtcgatacccgtaatggcaatattctggcgaaggttgcggcaccggaatcactggctgtgctgtttaacccagcgcgtaatgaagcctacgtgacgcatcgtcaggcaggtaaagtcagtgtgattgacgcgaaaagctataaagtggtgaaaacgttcgatacgccgactcatccgaacagcctggcgctgtctgccgatggcaaaacgctgtatgtcagtgtgaaacaaaaatccactaaacagcaggaagctacccagccggacgatgtgattcgtattgcgctgtaatagatatggcgagggtgaaaacggaaagaattgcctgacttttatcacgccgcatccggcaccttcgtcagtagtctgaatttgcccggcacgtagccgggcaattttgcaattaactcgatgtttcaggcttaaacacaatttcctgtttttcttcatcttcctcgacgactggcgcagtgctgtgaatttcagcaacgcgtttgcgcacaccaaaccaacctataaccagcagaataccgataatcggcagcgccgcgatggtataagtcccgttcgggtaatcgaacgccatcagcaccaggacactcagtaaaaacagtaatgtcagccaggaagtgaagggcgcgccaggcagtttaaaactgacatccgctgctttgccttctttaattgctttacgcaggcgcatctggcaaacgatgataaacgcccatgaagcgatgattcccagcgacgcgaagttcaacacaatctcaaatacgcgtgacggcaccagatagttgaggaatacgccgacgacatacacaaccagtgtcgccagaatcccggcatacggcacatgctgacgactcattttcgccataaaactcggtgcggaaccgcccatcgccatcgagcgcagaatacgcccggtgcagtacagacctgaattcaggctggagagggcagcggtcagcaccacaatgttcataatgctgccgatgtacggcacacccagtttagagaaaaacgtcacaaatggactttgccccgcctgatacgcgctccacggcaataacataaccagcaacaccacggagccgacgtaaaacagaccaatacgccaaatcacactgttaatcgctttaggcaccatggtctgcggatctttacattctccggccgctgtacccaccatttcaatggaggcaaaagcaaacactacgccctgaatcaacaccagcgcaggcagcaaaccatgggggaaaaagccgccattatcggtgattaaatgaaagccagtggtgttgccatccagcggctgaccactaccgaggaacactgtacccacgaccaaaaaggttacaatggcgagcactttaataagcgcaaaccagaactccatctccgcaaaccatttcacaccgatcatattcatggtgccaacgatggtcagtgcagcgagcgcaaagacccactgcggcactccgccaaacgcgccccagtaatgcatatacagagcgacggcggtaatatcaacaatccccgtcatcgcccagttgatgaagtacatccagccagcaacataagcggccttctcacccaaaaactcacgggcataagagacaaaactgccactggaagggcggtgtaacaccagctcacccaatgcacgcagaataaaaaacgaaaacaggccgcagatcaaatagaccagtgccagtgcgggccccgccatttgcagtcgcgcccccgcgcctaaaaacaaacccgtaccaatcgcgccgccaatggcgatcatctgtacctggcgattgcccatcgctttgtgatacccctcttcgtgggcattaagccagcggcgtttcgcggcgtgctgatctgaagtgtcggtgtcgtgtttactcattgctctccctgattgctttaatgaaaaagtcatataagttgccatgaacaatgtttattcatcctggcgatgatagttatcaccattattctttatgggtataaaactatcggcgcagcatcctacccgttatcgataaacgatgcaaaacatccccttacaatcctgaaggggatttatacaactgacgaaaaaatgataaatccttttgctggataacctgtgtgctgtcctacacttaatctttaaaagattgtgaggggcatatgattaaggtgtatagcgtacccggctggggctctacaatcagtgagctgatgctaacactggctgatattccttatcagttcgttgatgtcagtggttttgaccacgagggaacttcacgcgatttattaaaaaccctgaatccgttgtgtcaggttccgacactggcgctgtaaaaataacgagattatgacggagacagcggcgattgcattgatggttctcgatcgtcgcccggaccttgcgccacctcttgggcgcgccgaacgtcaatagtttcaacggctattggtctggctggttgctaatgtctatccaacgttcactttcgccgattaccctaagcgttgggcatctgacgcacctgaacagttaaagaagagtgtaattgaatatcgcaaatcgctttatatctggctgaattcgcaattgactgctgaaccgtatgtgtttggagagcaactaacgctggtggactgttatctctgcaccatgcgcacatggggaccgggacacgaatggtttcaggataatgccccgaacattaatgcgattgttgatgctgtatgtcagataccgaaattacaagaagtattaaaaaggaatgtcattatttaacaataatgccggaggttaatgttaatgaatcactggcgtagttaactggatatccatttgtttgctatgaatagtaattaaagttggtacaactatttatatgattgatgtaatttcgttttttatatgaaatatcaatttaatataatccgaaaataaaacatcttttcgcatgtagagaaacatgtcgatatgatagtgcagtgcagatcatgtcatcagggtagggcggtagcgtatttaatcagggaaagattacgcaacgctgcttttttgtactgaacgattctcattttatgtttaaaaattgagatactccttatttcctgaagctgtttttcattgcttatacatgatcaaatactccttacataattaaggagaacaaaatgaaacttaatacacgccaacaatttgtattacttaaatagaccagtgaaggtacgtatcagaatatccggtgaagtgattaatatttcgttgaatatttctccggatttttgaaacctgctgctgtagaaattctgaacaggaggaattatgcctttagcagccaaacttaccgacaaaggcacccggcacgacggttattacgagaccgccatcaccgccgggtcatccaccgttttatcgatggtctccccgcagcccgtcagggagatccgctgacgccgcatgataaaccgaagcatccccctcatccccgaaaaatcgccagaggctcgtcaaccgtctttattgacggcctgcccgccgccagaaccggtgatgctattgattgcggcggcgtggttattggtggcggcacggtaaatataggctgatatgtctgagaggtcattatgtccttaaaaggtcttcgctttacgctggaagttgacggccaggagccggacacctttgcagtggtgaatttcaggttaatccagaaccagtcttatccgtttgtgatgagtgtggatgccgccagcgattcttttatgcagacggcggagatgctgctggagaagaacgcgacgctgactatctggcagggcgtcatcccgcagcgttatgtcaccggcgtggtggcgggttttggcatgcaggagaataacggctggcagatgcgttatcacctgcgtattgagccgccgttatggcggtgcgggctgcggcagaacttccgcatcttccagcagcaggatatccggacgatatcggccacgttactgaacgagaacggcgtcacggagtggacgccgctgttttatgaggaccatccggcgcgggagttctgtgtgcagtacggggagtcggacctggcgtttctggcgcggctgtgggcggaggaggggattttcttctttgagcggtttgcggcggacagtccggagcagaagctgacgctgtgcgacgatgtggcggggctgtcacaggcgggggagtttccgtttaacccggacacatcggcaggagcggagacggagtgtgtcagtatgttccgttatgaggcgcatgtccgcccgtcatcggtgcagagccaggattacacgtttaaggtgccggactggccggggatgtatgagcagcagggtgagaacctgaacggacagcttgaacagtatgagatatttgattatccgggaaggtacaaggatgaacagcacggcaaggatttcacgctgtaccggatagagagcctgcgcagtgatgcggaaaaggccacagggcagagtaattcgccgaagctgtggccgggaacgcggtttacgctgacggggcatccgcagaagatgctgaaccgtgaatggcaggtgatacagagtattctgtcaggggaccagccgcaggcgcttcatggcagccaggggagaggaaccacgctgggaaatcagttagaggtgataccggcggaccggacctggcgtccacgggtgcagagcaaaccgaaggtggacgggccacagagcgccattgtcaccggtcccgcaggagaggaaatcttctgcgacgaacatggtcgggtacgggtgaagtttcactgggaccgttatcacgggatgacggaggagagttcgtgctgggtgcgtgtgtcgcaggcgtgggcggggccggggttcggtaacctggcgataccgcgggtgggccaggaggtgattgttgattttctgaacggggacccggaccagccgctggtcatgggccggacgtaccatgaggacaaccgttcgccgggggacctgccgggaacgaagacgcagatgacgatacggtcgaagacctataaaggaagcggttttaatgagttgcgctttgaggatgcgacggataaggaacaggtctatatccacgcgcagaagaacatggacacggaggtacttaacgaccggacgacggatgtgaaacatgaccatacggagaccatcgggaacgaccagaagataacggtggtgaaggggcagacggttcaggtcgggaccagaaaagaagggggccaagaccagagtatcacggtggcgaacgaccggtgcatcacggtacgtaatgaccagacgctgcaggtgacgaatgaccggacggtgagcgtgagtaatgatgacggcctgtacgtcagaaatgaccgtaaagtgacggtggaagggaagcaggagcataagacgacggggaaccatatcagccaggtggagggaaagcacagcctggtggtgaagggggacctggcgaggaaggtgagtggcgcgctggggataaaggtcgacggggatatcgtgctggagagcagcagccggataagcctgaaggtgggtggctcgtttgtggtcatccattcagggggcgtggacatcgtcgggccgaaaatcaatctcaatagcggcggtagtccggggacgccggtgccggcgctgcaaccggcggtgctgaagacactgggggatgagaagagtggtgatggcagtgattccggagaagaaaatgaagactctggagggaactgcgtgaccggaagtggtggtgatgatcgaggtgacgatgaggatgaacctgaaaaatatactctccagttccattttacagacgatgacgggataccgtattcagaaacccgctacattgccttctttgaggatggcacgcagacccgcggagaaacggatgaagaggggtatacagagcgtttttttgtatctagcaaacatgaaattaaagtgaagttgctatttgcgaatgatgattttctctcaatggaaggacactatggacgataataatcaaacttctggacaaccaaagccagagccagaagaatgtgtgaaagagcaaaaaataacagatcattttaaaataatgattgataaggctcgtaaggcacaaaagttggttttgataaaaagagcagatgatcttttgagatggggagcacaggaggaatatgatttcagtaagatctttggtgttaaaggaaataaggaggttaatataagaaaatatggacataatacaggtaggcgcatgaatgctagatttcttatgatggatggtgtgagaagattaatgattatagctaatgatttaacaatgagcagttttataaattatacaggttgtaatgaatttgcagcattcgtcagcccaagtaaggatatgccctatataattaacataggcgcaaaatttgagtatagagatggcaaaaaaaatccagtaacgggaaaggattctcatgttgctactttatgtcatgaaatgtctcatattcagtggtattatggggataataaaaaaggtggtatgtggtcacaggattatacaactactgataaatattcaacgtgcaaagaggatgaagtttcatatgacgaacatatccgtattgcaactaaactgatctctaaacaaaaagatcaaatatttgagaatgcatataacatagaaagatattttgaaataagattaattgaaagtgagatagactcgattgatgatgaaatattaagcaattcagttaagaaaaaaatagcggaattagaaaaagcacttctccattaactaataagtcgagaaatacattaatgctgcaagctataaaaaaaatcataataatgacaatcgtaaatattatatttttctattcctttcaatcgactgcggatgaaatggttttaataaaaaaatacgggtttgggcttgagagagatatcaaaggaaggccattaatttatcctatcgaaaattatgatgagtgtaagaaaaaatgcaatcatatgaattatatagcggatgtcaatgctcaattagctatgagtaaaaaaaataacaggatttttgctaacataacctttactaacaatagctctaccacgtattttttttctaaatattatctacctatgaaagtaaaagatggaaaaggagatgaatatgatgcgatatgcaaaaaaccattcagaatcaactctgggaatatcacgttggactacttaggtggttcatgtccttttgaaattaatacgaaccctgaacggtggaatactattaaaccaggtcgtagttttttgttgagtataaccttaaatgatatatatgcctttataccaggagataattattattttataaaatcatctggctataaatttgttaatgacaagtggtttacactcaaatcaatcaataatatttttctttattttttaaatttaaaaattaattgtgctgatgatttttttgatattaataattttactacatgtaataatttgttattagatgaaaaaaacacttttttattaatcagttatgggcaattgaggatgaaaaaaattctatttacgtcacccctgatgaaatttctataagtatagacggcgataacttaaagttgccatattaggaatatgggaaagaacacggtgcgccgcttttttgcactaaataatttacattttatgttcaataattgatactaacatgttggatattaaaggtgaaattatcacaactgatgcgatgggttgccagaaagatattgcagagaagatacaaaaacagggaggtaattatttatttgctgtaaaaggacataaggagcggattaataaagcctttgagtgaaacttccgctgaaaattcaggttaaccgcgttccatgcaaacaattttcaaatattcatcaataaataaggagttccatgtttatacgaccagtcaaaccttcagatgttgaaccattaatggatatgctgcttgacagggatcaatttgatcaagatggccttcatcatgtacaaaaaacactaacacattatttctcaggtcaatctgccgatttatggtttagtgcagaacacttgggactggcagggattgcctactgtgcttctgaaatgatgacaaatgatgtctgaaatttattaatgctctggatcagtccttcccatcagcgccagggagtgagacatctgctgattaacgaaatagaaaagagctcacaattaaacaggcaagactactattagtagagaccgccagccatatcgattttagtgccgcccgcgcattttatacaaaacagggctttatcaatgaggcgataatacgcaattactatgatgttggtgaggataaattaatcttcactaaaaatatgcaatcgtgagataaaatatgctttaactcatatggaaacattgcttaaacaacttggttgctgcatatgattctttagcccgcggtaactcgcttaccactggtaacaaacgtgccagcacctaaatgatgcaacgtattgagcttatcatcatcaaactgccagcggccttcgacaaatacccgtgcgtctgccgctgctgataccacttcgccaaatagcgtatcgtatttttcttgcgcggaagttgcaggtagcaggcgacactccatccacgccagacatttttcctcgaccagcggcaaaccaagcaccgggcctctcactaccggaatgccgtagcaattaaatttatcttcttcacgacccgacacacttcccaccgcccacgtccagttagtcgccgcaacgcccgggataacgatgccaaacttaccgttacgttcaatcaactccctggtccatgtcgatttatctaccacaatcgccacgcgtggcggttcaaactctacgggcatcgaccaggctgctgccataatgttacgccgctgggattgctcatcgaaactggtgatcatgacagttgggccatgatttaacagacggctggcatggtgtaattcgacgggaatgaattggctcacgatatcgcctcgctatgaagggtgttttaaaagcgtagctcgtaacgcaataagtaacgaaattaacgggattggcgatttgcgaacgtgatgcatgtccgcgatcgcacaaaatagccagtgcggcgtctattccaggttataagttgagaaaaccactaagggaaacgcctgatgacgcccattctgaatcattattttgcccgtattaactggttgggagctgctgcggccaatattgatacgctgcgtgcattgcacctgaaacacaattgcaccattccgtttgaaaatctcgacgttttgctgccgagggaaatacagcttgatgatcaatcgctggaagataaactggtgatagcccgtcgtggcggttactgttttgagcagaatggcgtgtttgagcgggtgttacgcgagctggggtttaacgttcgcagcttgttaggtcgcgtagtgttatcaaatccgccagcattaccgccgcgcacccatcgtttgctgttggtggaactggaaggggaaaaatggattgctgatgtcggtttcggtgggcagacgctaaccgcgccgattcgtttaatgccggatatcatgcaaaccacgccacacggagagtatcggttgttgcaagagggtgatgattgggtattgcagtttaatcatcatcagcactggcagtcgatgtaccgttttgatctctgcgagcagcaacaaagcgattatgtgatgggcaatttctggtcggcgcactggccgcagtcgcattttcgccatcatttgctgatgtgtcgccatttgccggacggtggcaagctaacgctgaccaattttcattttacccattatgaaaatgggcacgcagttgagcagcgaaatctaccagatgtggcgtcgttatatgccgtgatgcaggaacagtttggtctgggcgtagatgatgcgaaacatggctttactgtggatgagttagcgctggtgatggcggcgtttgatacgcacccggaggcgggaaaataatttatgtcaggttgccggatgtggcgtaaatgccttatccggcctacattagcccggttgtagacctgataagcgaagcgcatcaggcaacggcatcaaaaatcaatggcccattcagcatggaatagaatcaccgccgtgccggaaatggtaactttctccggttggttatctcgaattgtcaccgtcacatcaatcacgccgtcacgccctaatgcgcgcccctgatggcctttaacacgcaacacgttgccatcgtggggcaatacgttgtgatgtactaaccatgcacccatcgggccattggcattcccggtcaccggatcttccacaataccaatcgcaggcgagaacatgcgaccatcggtttcgtttttgcatgggcggatctggaacgggaagaaaccattgcagccaatctgtttgctgatagcggtcagcgcagcaagatcaggcgaaagggcatcgatatccacttctggtttcaacgggatcatcacttttgagtgtcctgttgttgccacctgaattggcaagccttgcaaaatatcgtcttcagtgagatgaagcgcgttgataatcgctgcacgtgtttcaccttccagcggtggctcaaagcccggcgtaccttgttccagcgaaatacgataatcatcgttatgcttttcgatagtcacgcggtgttttcctgccagcgacgtttgccagaccgtgcaatttcccaaacctaatacctttgcacgtacatagtgcgcagccaccgtcgcgtgaccgcaaattggcgcttcaaccgttggcgtaaagtagcggatgcgcacatcgctgtcgtcgctgtgcagcagaaaagcagtttccgaatgacctaactcgcgggcgataagctgcatttgcgcttcactgagattatcggcggggaaaacaacaccggcagaattgccgcgaaacggttgagaggtaaaagcatcgacgtggtaaacctgcggtttcattaatgttctcctgtggctggagaactatcatagcctgcaagtggccggagagcgaagggctatccggcccgcgtgagaattaacgccgcgaacgcacaatctgatactgacgagtaaagtactcaaacggcgcgctccagacatgcaccagtcgggtgaacgggaagagcaggaagatggtcattccaagcaccagatgaacgcggaatataaaggcgacaccatcaagatgcgtagatgcaccgccctggaaagtgacaatgctttgcgcccagcccaccagcttcatcatttcactgccgtccggatgttgtgctgaaaaaggaatggtggttaacccaagaatgcactgaattaacaaaatggcgaggatcaggatatccgcaccagaagacgtcaccctgatacgcggatttgttaaacgacgcaccagtagccccgcaccgccaatcagcgtcaataccccgcatattccgccgaggatcatcgccatctgctgttttaccgccaccggcagaaaccacgcgtacatccagtgcggtgttaacatgccgaacaggtgcccgaagaaaatccccaaaatgccgatatggaacagattcgaccatatcaccatcccacgtttatcgagcatctggctggaggcggcgcgccaggtatactgcccgtaatcgtagcgcagccagcttccaaggataaaaaccgtgccacacaagtacgggtagatatcataaaaaaagacgttcagatactgaatcatttcccacctcccgcactgatgtcgacatactgcggcgcgacatcctggctaaagcgtcgctgatattgattaagcggcgagctgtcacacgccgtggcgttatcttcaataaacttcacctgttcttcttcccacaccgcatccagcgcctggcgggtgtcgtcacgctcttcactgcgaatctgttttgtgacactgtcacttgacagagggcttcctgccagttgcaacagggcgtcaaataacgcgtaccacggtgcctcgcgttgttttaagcgtccgccaagcagggcgaggatcggcgcaacgttgagtaatccttctttcgcctgatcgtccggaagtacgcttaaatactccagatacagcggtagataatcgggcagttccctacaattcagttgcagaccgaccttttcatactccgccagcagatccaccattgcctggccgcgatcgcgggactcggcatgaacatgttcaaacagcagcagcgacgtggtgcgcccgcggtcaaacacttcacaccattcggcctgtttatccagcagcggggcgttgagcaggtcgagtgcaaaatcggtgagcatcggcgcgtcgcggcggataagcgccagcgcgtcgtccttacactcccacaacaactcgtctgggtactccatcaacaggccgatcactttgaggatctgcattattcgccctccgctttgtcgcgcacttcggtgatgttgatggcatcgatacggctactgttgaacaggttgaatttgctgtccgaaccgtggcaaccgtcgccaaaggtaaaaccgcagccgttgcgttctgcgaaggcatcgcccgccatttcccgatggcttgtcgggatgacgaaacgatcttcatagttggcaatggcgaggtaacgatacatctcttcgacctgggcgacgctcagacctacttcgtcgatggcacgagtatcagtaacgccttccacggtttgtgaacgcatatagtggcgcatcgccatcatccgtttcagcgcccgcagtaccggaccggtatcaccggcactcaacatattggcgagatattgcaccggaatacgcaggctttcgatggcgggcagcatgccttcgcttttcggcaaacctcccgcatcagcgtaggactgaatcggtgacagcggaggaacgtaccagaccatcggcagggtgcgatattcagggtgcagcggtagcgccagtttccagtccatcgccattttgtagacaggcgaacgctgggcagcgtcaatcacgttttgtggaataccttgtttcagggcttcctcgatcactgagggatcgtgtggatcgaggaacacttcgcactggcgctcatagaggtcaacttcgcgctcggtgcttgccgcttcctcaatgcggtcggcgtcgtaaagcagcacgcccagataccggatgcgacccacgcaggtttcggagcacacggtcggttgaccggactcaattcgcggataacaaaatatacatttttctgacttgccgcttttccagttgaagtagatttttttgtatgggcaaccgctaatgcacaaacgccagccacggcatttatcctgatcgatcagcacaatgccgtcttcttcgcgtttgtagatagcgccgctggggcaggtcgctacacaactggggttaaggcagtgttcgcacaagcgcggcagatacatcatgaaggtgttttcaaactgcccgtacatctccttttgcatggcctcgaagttgcggtcgcgggctcgtttttcaaattcgccgcccagcagttcttcccagtttgggccccagatcactttgtccatccgtttgccgtcaatcagtgaacgcggacgggcggtgggaatatgtttgccttccggcgcgctatgcaaatgttcgtagtcgaaggtgaaaggttcgtagtaatcgtcaatctgcggcactaccgggttggcgaaaattttggttattacgcccatcttgctgcccagacgcgggcgtatcttgccattcacatcacgcacccagccaccttgccactcatcctgatcttcccagtttttcggataaccaatgcccggtttggtttcgacgttgttaaaccatgcgtactccatgccttcgcgtccggtccagacgtttttacaggtcaccgaacaggtatggcagccgatacatttatcgagattaagcaccatgccgacttgcgaacgtattttcattttttcgcctcctgaacctgatcgcgaccttcatcatccagccagttaacgttcttcattttgcggatcataatgaattcgtcgcggttcgagccgacggtgccgtagtagttaaagccccaggccagctgcgcgtaaccgccaatcatatgcgttggtttcgggcaaacgcgggtaaccgagttatgaatgccgccgcgcatgccagttacttccgaacctggaatattcataatgcgttcctgagcgtgatacatcatggtcatgcccggtggtacacgctggctgaccaccgcgcgggccgtcagcgcgccattggcgttaaacacttccacccagtcgttatcgacaatggtcagttcacgggcatcggtttcgctgatccagacaatcggtccaccgcgagagagcgtcagcattagcaggttttcactgtaggttgagtgaatgccccatttctggtgcggtgtcaggaagttaagggctttctccgggaagccgtttggcggtatctggcgcatttcactgacactgcgggtgtcgataggcgggcgataagccaccaggctttcaccaaaagcacgcatccacggatgatcctgatagacctgctggcgtcccgacagcgtgcgccacggaattaactcatgaacgttggtgtatcccgcgttataggagacgtgatcgctttccagaccagaccatgtggggctggagataattttacgcggctgcgcctgaatatcgcgaaagcgaatcttctcgtcctctttgtgcagcgccagatgggtatgttcgcgtccggtgatctcgcccagcgcttgccacgctttgactgcaacatggccgttggtttccggtgccagtgccagaatcacttctgatgcgtcaatggcggtgtcaatcagtggacgcccctgtgccgggccatcacgcttggtgtaattgagtttaccgaggaaatcaatttcatcctgggtattccacgaaatccctttaccgccgttgccaagtttgtccatcaatggcccgagcgaggtaaagcgttcataggtagcagggtagtcgcgttccaccgctacaatattgggcgcggttttacccgggatcagatcgcattcgcctttgcgccagtcgagcacttcacacggctgggagagttctgccggagagtcatgcagtaggggttgtaataccacgtcggtttctttgccaagatgacccacgcacagttgcgaaaatgctttggcgatacctttgtagatttcccagtcgctgcgtgattcccacgccggatcgaccgccgcagaaagcggatgaataaacggatgcatatccgaggtgttcatatcgtctttttcgtaccaggtggcggtgggcagaacgatatcggagaacaggcaggtactggacatacggaagtcgagcgtcaccagcaggtcgagcttgccttcaatcgccgcagtttgccactcgacttcttctggtttgatcccgtcgctggcaccgagttcctgaccctgaatcccactttcggttcccagcagatacttctgcatatactcgtggcctttgccggaggagccaagcaggttagaacgccagacaaacaaattacgcggatgattgctgccgctatctggttgttcgcaggccatgcgtaaatcgcccgatttcagcgcctgggcggtgaattctgtgggagataatccggccttgtcggcttcagctttaatcccgagcggattacgccccaactgcggcgcagaaggtagccagcccatacgttcggcgcgaacgttgaaatcaatcagatgaccgctgtacttactggcatcggcaagcggtgaaagtaactcctgagcagagactttttcatagcgccattggctggaatgattgtagaaaaacgaggtgctgttcatctggcgcggtggtcggttccagtcgagcgcaaaagccagaggcagccagccggtttgcgggcgcagtttttcctgaccgacatagtgtgcccagccgccaccgctttgcccgacacaaccgcagaagatcagcatgttgatcatcccacggtaattcatgtccatgtgataccaatggttgacgccagcaccgaggataatcatcgaacgcccatgcgttttatgggcggtatcggcaaattcacgggcgatggtttcaatatactggcgcggcacgccggtaatttgctcaccccaggctggggtgtacggtttgatttcagcgtaatctttcgcgctgttttcatcttccagcccgcgatcgaggccgtaatttgccagtaccagatcataaacgctgaccaccggacaggtgctaccatcggctaatgtcaggtttttaacgggcaattggcgcaccaggacaggattgtgttttacgctgcgaaaatgtggattttcaatgccgccaaagtaggggaaggccacgcctgcaacggcgtcatgttgaccgagcagggttaacgacaattcggtttccgtaccggcggcaatggattccaggttccatttgcctttttctccccagcgaaaaccaatcgaaccgttcggcactaccaattcacctgcggtattaactgccacggttttccactgcggattattgctttcgcccagtccatccaccaggtcagatgcgcggatcatgcgcccgggaacgtagctgccgtcgtcgcgaggttccagcattaccagcatcggcatgtcgctgtagcggcggcagtagttgataaaataatcgctgggattatcgagatgaaactcttttaaaatgacatggcccattgccattgccagggcactatcagtgccttgtttcggtgccagccactggtcgcacaatttggccacttcagagtagtcaggggtaatggcgatggttttagtgcctttgtagcgtacttcggtaaagaaatgggcgtccggcgtacgtgtctgcggtacgttagacccccaggcgatgatgtaactggagttataccagtcggcagattccggtacgtcggtttgctcgccccaggtcatcggtgaggcgggcggcaggtcgcaataccagtcgtagaagcttaaacaggtgccacctaacagcgacagatagcgtgttccggcggcgtaagaaaccatcgacatcgccggaatcggcgagaaaccggcaacgcgatccgggccgtaagttttgatggtccagacgttagcggcggcaatcagctgatttagctcctgccagttggagcggataaaaccaccgcgtccacgcacttgtttgtagctcaggctcttttgcggatcgttcataatcgatgcccacgccagtaccggatcgctgtgttgtttgagggcttcgcgccacagttcaatcagtcgtttacgaatgagcgggtatttcaggcggttagcgctgtagagataccaggagtaacttgcgccacgcgggcagccgcgaggttcatgatttggcaggtcagggcgagtgcgcgggtagtcggtctgttggatttcccaggtcaccagaccatttttaacgtagattttccagctacaggagcctgtacagttaacaccgtgggtggaacgcacgattttgtcgaactgccaacgctggcgatagctgtcctcccagtcgcggttgctatgcatcacctgtccgtgaccatcggcaaaggtttcgcccttttgtttgaagtagcgaaagcgatccaaaagtttactcatgacataactcctgctccaggaatgaattgggatctgatgccttgtcggatgcgacacggttgtagcctgataagacgtgtcaggcatcgatctcttatttttggctgaacttccgccgaccataaaccagccaggtcagtagcacacaaacgatgtagaagattaaaaacactttcatcgcgcccaccggagagccggtcatattgagcgacatgccaaacgcctgcggaataaaaaaaccgcccactgcgccaatggctgagataaagcccagagcggctgccgtttcggtgacggcttctctttgagcttgctcatcactaccgcctttcatcttcacccgataaattgttatctggcgaaagatgacggcgatcatctggaaagtagaaccacttcccagacccgcggtcagaaacagccccataaatacggcgtaaaatgcgatgaaattaccggagcctgtgcccggtaaggtaaggaacagcagggcgctgaaaatcgccataaaaatgaagttgatcaacgtcacccgcacgccgctgaatttatcggaaatagcaccaccaaccgatcgcgcgatggcaccgataaatgggccaaagaacgccaggcgcagaatattcacatccgggaactgggtttttgccagcatggcaaaacccgcagaaaaaccgataaacgaaccgaaggtggcaagataaagcaggctcagcagccagagatgcaggcgttgtaagacagggagctggtcggcaattgaggcgcgtgaactggcgatatcattcatccctgaccaggcggcgatcgtggcaatcgccagtaatggcacccaaatccatgcggcattcgccagcgacatcaccgaaccgtcggcctgcggtacgccattgacgccgagaaaggcaaatacgggtacaaaaatgaccagcggtgcaaccagctgcatcacacttacacctaagtttcctaatccgccattaatcccaagagcgctcccttgtttggcttttggaaagaagaaactgatattgcccatgctcgaagcaaagttcgcacctgcaaaaccgcatagcaaagcgataacgataaatatcccaaaaggggtattcggattttgcacggcaattccgagccagacgcaaggaataatcaggattgcagtactaaaaaccgtccatcggcgtccaccgaatataggcaccataaaggagtaggggatacgcaataatgcgccagaaacggagggtaatgcggttaataaaaagagttgatcggtagtgaaattaaaaccgattttattgagattaacagtaactgcgctaaatagcatccagacacagaaggcaagaagtaggcaactgactgatatccagaggtttcttcgtgcaatatgctttcctttattttcccagaaggccggattttctggtttccagtcgcgtaaaagataacgactatttttctcattttgcagtgccatattgttcctcacatgcacacattggtaatgaaaaaaagacaaaacaggaggtaaggcgcaatagccagttattagaattaaggatgaatcaggtgaagtgctgattagaagaatagataagaaagcgtaactgcgggggcagaatgtggattaaacagacagatatgtgttactaaatgtaactaaaatggctttctggtatttgaaatttattttttaatattgtcagaatttatctgattaactgccgggccgtagacccgacaattattttagccacgacgtgtcgccaggcagcagagcagggaaccgccgcagaccattagcgcgccttgccagaacgagaacgacagcggggcgctgagtaacacggctgcaagtgctgaggaaaggacgggcgtaaaatacgaacctaccgccattatggtgacgttgccatgtaatataccgacattccatgcagcatatgcaaatcctaaggtaaatgccgcagagatgagtttaatcatgacgggcgtgctaaataccatttctggttgtggcgtaagaaaatagtaaacccacagacttgctcccgttagcaggacaaaaacggtaattccgttaaatccgcgtgcgtatttattcgttactgtgcagtaggctgcccagataaacgccccaatgaacgccaggaaataactcaatgggctggtggtgatattattgataatttcatcataatgtaacccattgtcaccgcctaacacccagcagacgccgaccagggctaataataatcctggtacaatcagccagttggttttctgaccattaaacagaatggcaaagagaattgtcaggctgggccatagatagttcaccatccccacttcaatcgcctgatgacgggtcgccgcatatcctaaggaaagcgccagacagatttcatagctgacgaataacagactcccggcgagtaaatagcctttcgggatctgccgaatacgcggaaatccaaccgtgaagattaacagcagcccgcttaatgaatagatagcagctgcgccgccgaccgggccgagtccctcactgacaccgcgaatcaatcctaccatcgtgctccacaggacgatcgctattagccctatgagcgttgctttttgtcgtgtcatgctcgctgttttgtctctcttgccgttaaaaattaagctgaattttatagcatttttttaactgccctgtcaggcagtggggcgtttttctaccgctattgaggtaggtcaatttgcgcaggcggattattttgtggcaaacacgtgttctttttgatttcgcgcaaaaagattcagaattttactgttagtttcctcgcgcagtaatacccctgaaaaaagaggaaagcaatggacgtcagtcgcagacaattttttaaaatctgcgcgggcggtatggcgggaacaacagtagcagcattgggctttgccccgaagcaagcactggctcaggcgcgaaactacaaattattacgcgctaaagagatccgtaacacctgcacatactgttccgtaggttgcgggctattgatgtatagcctgggtgatggcgcgaaaaacgccagagaagcgatttatcacattgaaggtgacccggatcatccggtaagccgtggtgcgctgtgcccgaaaggggccggtttgctggattacgtcaacagcgaaaaccgtctgcgctacccggagtatcgtgcgccaggttctgacaaatggcagcgcattagctgggaagaagcattctcccgtattgcgaagctgatgaaagccgaccgtgacgctaactttattgaaaagaacgagcagggcgtaacggtaaaccgttggctttctaccggtatgctgtgtgcttccggtgccagcaacgaaaccgggatgctgactcaaaaatttgcccgctccctcgggatgctggcggtagacaaccaggcgcgcgtctgacacggaccaacggtagcaagtcttgctccaacatttggtcgcggtgcgatgaccaaccactgggtggatatcaaaaacgctaacgtcgtaatggtgatgggcggtaacgctgctgaagcgcatcccgtcggtttccgctgggcgatggaagcgaaaaacaacaacgatgcaaccttgatcgttgtcgatccccgttttacgcgtaccgcttctgtggcggatatttacgcacctattcgttccggtacggacattacgttcctgtctggcgttttgcgctacctgatcgaaaacaacaaaatcaacgccgaatacgttaagcattacaccaacgccagcctgctggtgcgtgatgattttgctttcgaagacggtctgttcagcggctacgacgctgaaaaacgtcaatacgataagtcgtcctggaactatcagttcgatgaaaacggctatgcgaaacgcgatgaaacactgactcatccgcgctgtgtatggaatctgctgaaagcgcacgtttcccgctacacgccggacgtagtagaaaacatttgcggtacgccaaaagccgacttcctgaaagtgtgtgaagtgctggcctccaccagcgcaccggatcgcacaaccaccttcctgtacgcgctgggctggacgcagcacaccgtgggtgcgcagaacatccgtacgatggcgatgatccagttactgctcggtaacatgggtatggccggtggcggcgtgaacgcattgcgtggtcactccaacattcagggcctgactgacttaggcctgctctctaccagcctgccaggttacctgacgctgccgtcagaaaaacaggttgatttgcagtcgtatctggaagcgaacacgccgaaagcgacgctggctgatcaggtgaactactggagcaactatccgaagtttttcgttagcctgatgaaatctttctacggcgatgccgcgcagaaagagaacaactggggctacgactggctgccgaagtgggaccagacctacgacgtcatcaagtatttcaacatgatggatgaaggtaaagtcaccggttatttctgccagggctttaacccggttgcgtccttcccggacaaaaacaaagtggtgagctgcctgagcaagctgaagtacatggtggttatcgatccgctggtgactgaaacctctaccttctggcagaaccacggcgagtcgaacgatgtcgatccggcatctattcagactgaagtattccgtctgccttcgacctgctttgctgaagaagatggttctatcgctaactccggtcgctggttgcagtggcactggaaaggtcaggacgcgccgggcgaagcgcgtaacgacggcgaaattctggcgggtatctaccatcatctgcgcgagctgtaccaggccgaaggtggtaaaggcgtagaaccgctgatgaagatgagctggaactacaagcagccgcacgaaccgcaatctgacgaagtagctaaagagaacaacggctatgcgctggaagatctctatgatgccaatggcgtgctgattgcgaagaaaggtcagttgctgagtagctttgcgcatctgcgtgatgacggtacaaccgcatcgtcttgctggatctacaccggtagctggacagagcagggcaaccagatggctaaccgcgataactccgacccgtccggtctggggaatacgctgggatgggcctgggcgtggccgctcaaccgtcgcgtactctacaaccgtgcttcggcggatatcaacggtaaaccgtgggatccgaaacggatgctgatccagtggaacggtagcaagtggacgggtaacgatattccggacttcggcaatgccgcaccgggtacgccaaccgggccgtttatcatgcagccggaagggatgggacgcctgtttgccatcaacaaaatggcggaaggtccgttcccggaacactacgagccaattgaaacgccgctgggcactaacccgttgcatccgaacgtggtgtctaacccggttgttcgtctgtatgaacaagacgcgctgcggatgggtaaaaaagagcagttcccgtatgtgggtacgacctatcgtctgacggagcacttccacacctggaccaagcacgcattgctcaacgcaattgctcagccggaacagtttgtggaaatcagcgaaacgctggcggcggcgaaaggcattgccaatggcgatcgtgtcactgtctccagcaagcgtggctttatccgcgcggtggctgtggtaacgcgccgtctgaaaccgctgaatgtaaacggtcagcaggttgaaacggtgggtattccaatccactggggctttgagggtgtcgcgcgtagaggttatatcgctaacactctgacgccgaatgtcggtgatgcaaactcgcaaacgccggaatataaagcgttcttagtaaacatcgagaaggcgtaagggggcgaacagatggctatggaaacgcaggacattatcaaaaggtccgcaactaactccatcacgccgccttctcaggtgcgtgattacaaagcagaagtcgcgaaacttatcgacgtttccacctgtatcggctgtaaagcctgtcaggtggcgtgttcggagtggaacgacatccgtgatgaagtggggcactgcgtcggggtttacgataaccccgccgatctgagcgccaagtcctggacggtgatgcgctttagcgaaaccgaacagaacggcaagctggagtggctgatccgtaaagacggctgtatgcactgtgaagatccgggctgcctgaaggcatgcccgtctgctggtgcaatcattcagtacgctaacgggattgtcgatttccagtcggaaaactgcatcggctgtggttactgcattgccgggtgtccgtttaatattccgcgcctcaacaaagaggataaccgggtatataaatgcacgctctgcgtcgatcgcgtcagcgtcggccaggaaccggcttgtgtgaaaacctgtccgaccggggctatccacttcggcaccaagaaggagatgctggagctggcggaacagcgcgtagcgaaactgaaagcgcgtggttacgaacatgctggcgtctacaacccggaaggggtcggtggtacgcacgttatgtacgtgctgcatcatgccgatcagccggagctgtatcatggtctgccgaaagatccgaagatcgatacctcggtaagcctgtggaaaggcgcgttgaaaccgctggcagcggctggctttattgccacttttgccgggttgattttccactacatcggtattggcccgaataaggaagtggacgatgacgaggagggaaatcatgagtaagtcgaaaatgattgtgcgcaccaaatttattgatcgcgcctgtcactggaccgtggtgatttgcttcttcctggtggcgctgtccgggatttcgttcttcttcccgacgctgcaatggctgacgcaaaccttcggtacgccgcagatgggacgcattttgcacccgttcttcggcattgcgattttcgtcgcgctgatgtttatgtttgtgcggtttgtgcatcacaacatcccggataagaaagatattccgtggctgttgaacattgtcgaagtattaaaaggcaatgagcacaaagtggcggatgtcggtaagtataacgccgggcaaaagatgatgttctggtcaatcatgagcatgattttcgtgctgctggtgaccggagtgattatctggcgtccgtactttgcgcagtacttcccgatacaggttgtccgttatagcctgctgatccatgcggctgcgggtatcatcctgatccacgccatcctgatccatatgtatatggcattctgggtaaaaggatcgattaaagggatgatcgaagggaaggtgagccgtcgctgggcgaagaaacaccatccgcgctggtatcgtgaaatcgagaaggcagaagcgaaaaaagagagtgaagaagggatataatctcttttgagctttaagctgaaaatggcgctgtaaaaggcgccatttttttattgtagacaacgtgcactttgttcatgccggatgcggcgtgaacgccttatccggcctacaaaccgttcaaatccaggagcagtgaacgtgtaggcctgataggcgtagcgcatcgggcaatgttgcgtttgtcatcagtttcaaatggcgctttataaggtgccatttttttattgcgtaaccagacggcgcagtcgcgacacatccactgttttttctgcctctgccagactccaggcattttgcagattcagccacatttgcggcgaactgccgatcaccacagacagttttattgccatttctggcgtcaaagctgcttttccggtcagcaatcgacttgccgtagagggcgcaatttccattgctctggcaaactcgcgcaggctgacattaagttcgtccagtgattcctgaataatgtcccccgggcggggatgattggccattttcatcagtgatagtcctcgtaatccagtatgtatgcatcgccattgacgaattcaaatgtgattcgccagttgcccgagacagatatcgcccaaattccatcgcgatcgccgcttaacggatgtagtcggtaaccgggcatatcgatatcagcaagacagcatgctgcatcaatcacagcgagtcggtggcgtaatcgtttgacttgcgtcggtataacgccggaggttttgccgagaagaaacaagtcacgcaatcccttgtgtctgaaattcattatcatctcttcatccttgttccctcgaaaggaacactatcactattgttccgcacagcgcaacaaatttcgctacgttttcgcgaattgtgaggggaaagatgggggaggaaaagaagaagagtgaaattgcggaaagcgtctcgcaaaacaggctgcgacccgaacatggcagtcgcagcaaagacctcttagcgacggaaatcaatcaccatacggccacggattttgccttcttccatctcggtaaagatggtgttgatgtccgctaacggacgcagggcgactttcggcaccactttgccttcggcggcaaactggaaggcttcggttagatcctgacgcgtgccgaccagcgaaccgaccacttcaataccatccagcaccagccgtgggatgtccaggctcatagactccggcggcagaccgacagccacgacacgaccacctgcacggacagcatccaccgccgagttaaacgcagctttagctaccgctgtcaccaccgctgcgtgagcgccaccggctttctcctgcacaattctggcggcgtcttcggtgcgtgagttaatcgctaaatctgcacccatttcggttgccagttttaactgttcatcattgacatcaatggcgatcactttggcgttaaagacattcttcgcgtattgcagggcgaggttacccagaccgccaagaccgtagatagcaatccactgtcctggacgaatttttgacagcttaacggctttgtaggtagtgacccccgcacaggtaatgctgctggccgccgccgagtccagaccatctggcacttttaccgcgtaatcggcgaccacgatgcactcttccgccatcccgccatcaacgctgtatccggcatttttaactgaacggcagagcgtttcgttaccactgttacagtattcgcaatgaccgcatccttcatagaaccacgccacgctggcacgatcgcctggttttaatgaagtaacaccagggccaacttctgccaccacaccaataccttcgtgtcccagaatcacgccggttttgtcaccaaaatcgccattcttaacatgaagatcggtatgacatacaccacaacactccattttcagcagggcttcgccatgtttcagtgagcgcagtgttttatccgtaacgtcaacatgatgatccttcgtaacaactgcagccttcatagttcctccttttcggatgatgttctgcatagcaggtgaggcaaatgagatttattcgccactacccagtatggatgagatctgaaaaagggagagggaaattgcccggtagccttcactaccgggcgcaggcttagatggaggtacggcggtagtcgcggtattcggcttgccagaaattatcatcaatggcctgttgcagagcttcggcggaggttttcaccgccacgccttgctgctgcgccattttgccaaccgcaaacgcaattgcgcgggatactttctgaatatctttcagttccggcagtaccagaccttcgccgttcaggaccagcggcgaatactgagcaagcgtttcacttgccgacatcagcatttcatcggtgatacgtgacgcgccggaagcaataacacccagcccgatgcccgggaaaataaaggcgttattacactgggcgatagggtagattttatctttccataccactggattaaatggactgccagtggcgaccagcgcgttaccttcggtccaggcgataatgtcctgcggtgtggcttccacgcgtgacgtcgggttagacagcggcatcacgatcggacgcggacagtgtttatgcatctcacggatgatctcttccgtaaacagtccggtctgtcctgagacgccaatcagaatatctggttttacattgcgcaccacatccagcagtgacagcacatcgctgtcggtatcccagtcgctgaggttttcgcgcttctgcaccagtttggtctggaaaggcagcaggttcggcatcttgtcggtcagcaggccaaagcgatcgaccataaagactttctgccgcgccgcttcctcgcttaatccttcgcgctgggtctgggcgatgatcatttcggcaatgccgcatcccgctgaacctgcgccaaggaagacgatttttttctcgcttaactgaccgcctgccgcgcggctggctgcgatcagtgtgccgactgttaccgccgcggtgccctgaatgtcatcgttaaaagaacaaatttcattgcgatagcggttaagtaacggcatcgcatttttttgtgcgaagtcttcaaactgcaacagtacgtccggccagcgttgtttcacagcctggataaattcatcaacgaattcatagtattcgtcgtcagtgatacgcggattacgccagcccatatacagcggatcgttaagcagctgttggttgttggtgccgacatccagcaccaccggaagggtataggccggactgatgccgccacaggcggtatagagcgacagtttaccgatcggaatgcccatcccgccgatgccctggtcaccaagccccagaatacgttcgccgtcagtcaccacaatcactttgatattatggtttggtacgttttgcagaatatcgtccatattgtggcggttctggtaagagataaacacaccgcgtgaacggcggtagatctcagaaaaacgctcacaggctgcgccgacggttggggtgtaaatgactggcatcatctcatcaagatgattgtttaccagacggtagaagagggtttcgttagtgtcctggatgttacgcaggtagatgtgtttgtcgatttcggttttgaatccctgatactggatccatgctcgttccgcttgttcttcgatggtttcgaccacttccggcagtaaccccagcaggttgaagttacggcgttcttccatgctgaaggcgctgcctttattcaacaacggaaattccagcaatacagggccagcgtaagggatataaagcgaacgctgtttttttgtttttggttccatgtcactcactcttttttgaatatccatccctgggggcttttatcgtctttgcattaccgccagggcgtcaagtaccaagtataaagcagataaaaacaaaaacaccattgcgcaggcaatggtgtttaatcgtcattgaggactgatggttatgaattacttttcagcggggcgttttctgccggtgggattatttaccacgctggatttgtcaccttcggtaactattttgcgctggttagaaattttatggtccagtccaagaatatgacgtgcctgacggttcgatttcattttaactcctcaatcctgttgctagttttaaggacaacatcgccgtagcgaagaaacacgtgctaaacccctaaattaggttgccgatcaagcatagcaccttaaagcgtagggtgctgaccactgaccacataattgatcgtttgctggtagatatcactgaggatgtcgttatcagatgcttccacccatttggtcagctccatgagaatgtcatcttcagtgacaacaccgtgctctgcccgaaggccttgctcaatggcattaaccagagcgggttctgctgttgaattttctgcctgataataagtaaacatagtgattctccgtgtctgtgtatttatggtgtctgctacggatcgcagatttataaagcacattcagcatggcaaatatttgccgcttcgttgttaagattagtcctggttgatgatttttatattttaactccatgatattgataggtattattattgtgatgagttgattgatattgatgcaatatctcttgagttatatatttccggttatctattgtggaaatttaatttaagtgcaggaattatattttcgccggattttattcggattatcctgcttatcctcgtgctgtttctcacgtagtctataatttcctttttaagcccacaggagagcaacaatgacaatccataagaaaggtcaggcacactgggaaggcgatatcaaacgcgggaagggaacagtatctactgagagcggcgtgctgaaccaacagccgtatggatttaacacgcgttttgaaggcgaaaaaggaaccaaccctgaagaactgattggcgcagcacatgccgcatgtttctcaatggcgctttcattaatgctgggggaagcgggattcacgccaacatcgattgataccaccgccgatgtctcgctggataaagtggatgccggttttgcgattactaaaatcgcactgaagagcgaagttgcggtgccgggtattgatgcctccacctttgacggcattatccagaaagcaaaagcaggatgcccggtttctcaggtactgaaagcggaaattacgctggattaccagttgaaatcgtaaagcgttgccggatgacgcctcaggcgcgtgaatgcctgatgcgtcagcacaatcacatcaggctgagaagggattgttctgacatggctatgcgttgtcgttgtccaactaaacgtagcggaaatcacagtatttaagtgacagtgtcacgttaaataaaaacccgcgagtgcgggcgagaggaatttgtcagattttcagcggtaacacgctgctcatccagcctggaatttcttcggcgggcagggggcgggaaaagaaatatccctgaataacgcgacagtggatcttgcgtagcatctcaaattgctctttggtttcgatgccttcagccacgacggttaaattgaggctttgcccaatgctggtaatggcttcgagtaaggcaaggatgcgtttttcggtcagacaacgatcgacaaaacttttatcaattttgatttccgttacaggaagactgactaagcgggataatccggaaaagcctgtaccaaaatcatctaccgataaaccgatgcccatatcgcgcaggatctgaatgcgcttaaagatttcggtatcgtgttccatcatcatgctttccgtgatttccaccgtcagctggtggccgtcaataccccaggcgtgcattgcatcagatacctgattaggcagctgattactgcgaaagtgcagcgcagacaagttaacggataacgccgggatatgaatattctggctacgccattctgctaactgacggcaagcttccgagatgacccagcgcccaatattttcgatttcaccaatctcttctgcgagaggaataaaccgtgaagggggcacatgaccatgcaggggatcgtaccagcgagcaagggcttcgatgccgtacagttcacccgtttctgcgaagatttgcggctgataaaccagtttaagttggttattgctaatcgcttcttttagcgctgcgcctaaaaccaaacgctcttttaccatttcgttcatcgccgggctgaagaactgccagccgttaccgccatttttgcgaataaaatccattgcattgtgagcagtggagagcaagtaatcgcggtttttaccctcgtcgtagctgatgccaatgctcaaggtgagcgggaatggtttatcgtcaatcattatcggcttgctgaccacattccgtagctcatcggcgatctgggtaatgttactgacatcgttttccaggctcacgaggacaaaagacgcaccttcaatacgacagagatactgatccggtttgagtttttcacgaaagcgattgaccacttccagcaatgcctgatcggcccacgcatagccaaggctatcaatcacatcctgaatatggtcaacaccgatgagatacaccaccggagagacggctttgtcgaccaggtcatcgaggtaattgtgcaggttattgcgatttggcagaccggtcatcggatcaaattggatgagttgttcaatatgctgacggcttttttcctgttccagcgccagcgcggccatatgctggctgatatctgccacgcgttcgataaaggcgctggtttctgctcctgacgaggttttaatttgcaggatccccgcaggcgcgccatcgcgctgacgaatggtcgctgaccagctttgcgcattttgaacttctgcaccgtgcgaagatgacgcccagtgtatcggcatcccgttgcgcagcgcgaacagcgaaacatgcgattcgttgagaacagattcgatgttacgacaaatgatttcccccatttcatgaaatggggggctgctgcacatggcggcgagaatattgccttcaagctggcggatttgcctttcttcggtgatatccgagaatgtcattaccaggttctgcagatgcgcgagcacgtcataaaccgggctgatagaggctttaatccagattttttcaccggtgcgcgtcaacagcagaaattcgtcctgatcgcgggcggttttccatagcaactgttgtaaacgaatacggttatcagcagggaattctggaatgttcaggagtgtatcgggctgcataccgctggcttcgttaatgcagtaaccaaacatttcggtaaatgcgcgattgcactgcacaatatggcgttccggatcgaggacaatcaccggtcggtcgagatggtcaacggcaataatcaattgtcgggtctgttctttttgcgccatttctacgctggcatcccgtaccagcgccaggtaataaactttcccctcggcgctcactttcgatagcgcaaaacgggtccagattttactgccgtcttttttctccagctgcagctcccgactcatcccctcgacgcgcgctttaccaccttcacggttgtgacgaatgtattgaggatgcgcaggacgcaaatcccgcggaatcagcatatcaatgttattgccaatgacttcttcacgtttgtacccccagagcttctctgcggcggggttgaaaaacatcacttcatcattttcgttaattaacaccgcgcccatcatattttgctcaagggcggggaaaaaaatgccatcggcagcattatccgcatcggttagcttcatgattacctctgcatcctggcgcatctaaagactggctttacagagttcaacacggtttctacctcgtcttttggcgatatacagagcttcatcggctatttgaatgaggcgctcatagtcaggatgaccattaaacatggcggcaccgatggaaagtgagagggcaatatcctcgccgtttgcggctttaaaataatgtcgacctttatggttaaaccgcaggccaaaatcaacgaaacgcaacgtgcgagatcgactaactgcaccatattctcctgaaatatgaagatatactgaaaacaaataagcgacttaggacagtttcaatctacgctactgttcttcagaagagtatagctcatcgtaattatttttcggtgacagcgaatatcgtatgttttttcatatttatacatttttattaggggaattatggctgtttaactaagtgtggttaattgcgtggttaatttgacgtatttaagcatgattgctagtgggatagttcaagagggtaacaagccagtgggtaaagcaccggcttgttacaaagtaagaatgggagtttaactgccccaacgactttgcagatagctgaccgcttgttgagtctgcggtttattcagatagtcctcacggaacaagattgtgccgctaatttccggcacagcatcgttaagatcgagctgctttttcagttctggtacgccgccgttaatcatccagtctggctctatctttgaaggttctcctactttatagaaggcgataccgatatacaggcgggtcctggtcggtttaacgacatccgcccaccattttgccaacacgtcataacgcgcggcactccgtgagaatggccagtaaatttggggagcaatgtaatccagcaacccttgttccacccatcgacgggtatcagcgtaggattcgtcataggctgccgcgcctcgggtatcggaaccgagcggatcgtgtgatcggttacgccacacgcctgctgggctaacgccaaattcgacttccggcttaatgcttttaatggtgtgcgataccttcgcaattaactgctgagtattgttgcgccgccagtctgcttttgacgcaaatgcgccgccgtatttgcggtacgtttcgttatcatttagccgtgaacctggtgattcagtatagaaatagtcatcaaactgcacgccatctaccggatagcgggaaaccacttccgcaactattgatgtgatccagtcctgaacctcagggatgcccgggtcgaggacaaagcgatcgccggacgttctgatccagtcgcggtgttgcacatagacgctggccggttgttgagacagggtgctattcagttccctgatagtaccgggcttcgtattaaccgatacgcgataggggttaaaccaggcgtgtactttcatcccacgcttgtgggcttcgtcgagcataaattgcagcggatcgtaacccggattttcaccaatcttaccggtcataagatcggaccacggcaaaattttcgatggccacagggcggtaccatccggcttgacctggaaaaagaccgtgtttatgccgatacgttgcagatgatccagtttgtcgatcatcgcctgttgttgtacacgtgcccggctggtggggtaactaatgttaaccgaggaaaccggtggccagtcgaggcgagacaccgtggccagccagatgccacgcatcggttgtgacgattgttgcgtcgtggctggtggctttgagcccgctggtggtgtcaccatggactctggaggcgtgcttttacaactacacagtaaaagtgccagtgcaaccagtatcgctggtcttctaatcgctaatttctcgtttcgggagcagatatccatatgtgctggtttccggtaaacagatgtgcgctcattctcgtacttatcccggttaagtcaatacgacaacaagcacgaaaaagggagcgatgaattatcgctcccttgtcttataaccattcagatatggttagtgtttcttgtcattcatcacaatatagtgtggtgaacgtgcacgcgggtgcaggaagaagtgaccttttggtgcgttctgactgttgattggctccagagtgacgccggtattcgctttgcttttacgatcatgaacagcatagagaataaagggcagggcaagtaccaccaggaaactaacgaccagtaattcaacatacatatcggtagagtcaccctggatgttatccggcggcaggaaggaaacaataaacgccataattgaagtcagcagaccgacaatagccacgaccagtttcacccctttaccaccagggatattaaatgtgcgttttaagtcaggatgtttaagaaccaacacaatgtagccaataaacagcatgaaataagcacacagataaatcaccaccgtcagcgccagtgcgatcaggaaggacatgttgttaccgccaccggtattggtgaggatgatcaacgcgatagaagtaatcaccagctgcgaaatgaccagcgttaccggtacgccatttttgttcattttagcgaatgccgctggcagcaggtttttctgcgctgtgacatacatcccgcgagaaggaccaacaatccaggaagcgatttccgccagaacacccagcaacagcagtgcggagatcacgcgaaccgtccactcaatttccggtgccacatgtgacatcagaacggtaaaggtttgcattacccctgcggagaggttgatttcattacccggaatgaccatcgcaatagacaaaccgccaacagagcttaagcagattgccgccaccatcagcagtaacatagccagtggatagtcgcgcccggggttgctcatttcattgacgtgggttgcggaagcttcaacgcccatataactcaaaatgaaggcaacaaatacaaccagggtgcccactttagagaagtcagggaagaaggtcttcgcatccatttcgatagcaacgggggcaccggagtgcagataaatagccgctaatgcgatcaaaataaatgcaggtaacaggataccggcgaagaagccaactttagcaattcgcgccgtgtatttcgtgccaccaaactgcgttaatgccagcgcccaaagaatgatgagtgctgcaatagttttggtaatggggtcttcattcagcgctggccatttcaggatgtaggagagtgcccctaacacgaaatagagcatcggaataaaaccaatggcgatttgcagatagccaaatgagatcgctgcaaatccccatctcggccccagagtatttgatacccaggcgaagacgccaccttcttcccagccgtcgacggtagccatttccgcagcacaaagtcccacgggaataaaccataaaatcccgcctaatagcaggaagaagactaatgaaaagcccgatgttgcgaaggtagggtattcataaacagccattaccatcgatgccgttatggcaaaaaatccgagtaatgtgagctgcttagctttacctgtctgtactgatgtagccatattatccccctaaaacggtattcctgtcggaaccgcacctgttttgttctgaagcgtattcagaacaatattttccgttgctaatgccagtgaacagactttggaaattgtcccgaaacggcttcgtttcgggacaccgttaccgttaaacgttatcaggtgtgtttaaagctgttctgctgggcaataccctgcagtttcgggtggtcgctgagatatttcagggaggctttgtagtcttccagcaacagttcagcaaagtccatttcgaagccgcgacgacacataatgcgcatcaccacgatgtcagtggcttcaccgccgagagtgaaggccggaacctgccagccgcgcagacgcagacgttcagagaggtcatacagggtgtatcccggatcttcaccatctttcagtttgaagcaaaccgccgggatgccttcgtccgggcgaccggtacagatgaactcatacggccccagtttggcgatttcatccgccagataagcagcaacctggtaggaagcgttctgtactttggtatagccttcacgaccgaggcgcaggaattcataatactgtgcaatcacctgacccgccgggcgggagaagttgatggcgaaagtaccaatctgaccgccgaggtagtcaacgttgaacaccagttcctgcggcagcgcttcttcatcacgccagataacccagccgcagcccagcggagccagaccgaatttatggcctgaagcactgatcgatttcacacgcggcaggcggaagtcccagacgatatccggggcgacgaacggtgccaggaagccaccgctggcggcgtcgatgtgcatgtcgatgtcgataccggtgtcggcctggaatttatccagcgcatcgtgcagcggttgcgggaactcatagttaccggtataggtcacgccgaaagtcggcaccacgccgatggtattttcgtcgcaggcttcaatcatgcgtttcgggtccataaacaactgaccggggcgcatagggatctcacgcaactccacatcccagtagcgggcgaatttatgccagcagatttgtaccggaccgcacaccaggttcggtttgttagtcggcttacctgcagcttccatacgcttgcgccaacgccatttcatcgccatcccgccgagcatacaggcctcggaagaaccaatggtgttggtgccaacggcctgaccatttttcggtgcaggcgcatgccacagatcggcaaccatgtttacgcaacgcagatcgattgctgcagattgcggatattcttctttgtcgatccagtttttgttaatggataaatccatcaacttatggacattatcgtcgtcccaggtctggcagaaagtggccaggttctgacgagcgttgccatcaagatataattcatcattgataatctggaatgcgacatcatcacgcatttcgtgcagcggaaaacgttttgattctgcgatagtggaaatagacttcgcaccaaaacgtgaatcgagtagttccgaccttaaatccgttacttgcttcttatccattttaaactccttaaaatgattggatcgcattaaaaaagtaggatttatcgataaagtaagcaagtgcaaaggactcggttttaaataacaaaatcctaatgttatttatcgcgagatattgcgtgaataatgtatttttattaaaaaacaacataatagagaattctgtgtggaggtaaggtgttttatgttgttattttatgtttttctatcgtctcctgaattatcacgtaaaaatcagaccttataatatcattattagtacacggttatttactttgaacacatttataaaattattacataaaaatagcgaatattgataaaatccccgccaacgatgtgttgacggggctgtgattattttggcaataatactccggtataggtattcaccggatgagaaagatattgtttaacagtagtgttaacattctctaccgtcatttgtttcaacaattgctcctgctcagtccatgctgcaggatcgtcatattgaataagactatttacaatggtattcgctaattgttgaacgctacgctgttggatatcgaggctgcgctgaacgttttgctggtattcgttcagttcttgctcactaatccctttggccagacgcttaaccatcacttcattcgctaacgttaacagttcatcatgtcgttctggttgacaagtaaaagccagcaaatgactgatatctttggcctgaggatcaaccgagaggcgagaagaaacgctgtatgccccagatgcctgttcacgaatattaatgcgtagatcttttgccagtgcgacgttaaaagcatcgagcgccatacgcgtcgtcagattaacaggtgtccgggaattataacgcttccactgtgaaacctgtgccactggttcattttgttcttttacagtaaccgatgcgttgtccgtcgcgcgagttaatggtttacctgcggctaatggcgaatcagagtgtttgattgatcctaagtaacgcgtaattaacgccacgagtttgtcttctgcgacattaccgacaatgacaaacgtgatatccgctggagatgaaaacaactggcgatcggcagccagtgcatctgcggcagtaaactgtgcaatctgattttcttgcggtaatttcgtgcggtcatcggcatagcgcgtctcatacatctgctgggcgaatttctccgctggacgctggtcgagcgttttcaacgcctgaatttgagcattttgtagcgatgcccaaatattgtcgttaatcgtgctgtgggtgattcgctggttaatcaactggaaaccaggttcagggttattagtccgcgcactaacggagagcaacgtattcatgctactgactttactgctcatggttaccgagttttccgcactccagcgtttcaggctggaagaggagagttcaccaacgccgcttccgcttactgctttattagccagcgcgataagtgatttttgctgcgcagggaaacatcgcctttattagatacggcaataatttcgcaaaggaagatgatgaagacgaaacacccgacaggaatttatgtcgggtgccttgttaaggtcataagaaggaggctaagaatggagctaagggggagcgttattaattattctccatttgttttgcaacatccataatgtggtaaagcggtaccctgttcttagctaactccaccatggcgttcatataaggtaccatggttgaaaaaaggattttataaccttcgcaaaaataagaaacagtctcattgtttactttagtaatacgatgcttaggacaaccaccattgcagataggtttatatgcacattgctgacatttggctgaaatccgttttttttgcgctgtcagttgtacactgttcatcgttttgagttccgatttattaatgtttccaattttgtactgtggatagacaaaatggtcgcattcgtaaatgtctccattactttcaacaaccagattatccttgcaggactcctggaaaatacaactggtatgcccattccccaaaaaacggctgacaaagctttcaaactgacggatgaaaatttcacccacatcgtttttaacccatcgcataaaaatggttgacataaacttgccataagccgtgggaggcacagaaaaatcaatgatacggaatgtgttctcactatgaccactgaaatcaatattcggcgtcccggtttcgagcaattcgataaattgcatatgtttactgccgatagattttaaaaaatgataaacctcaagagggtaatggacattaatgttattaatgacagttaacgtattaaactctatttgatatgatttcagacgctcgatggctgctatcacttttgcaaaagtaccgttacctgaattactgcgtctgtagcggtcatgtagttcttggggtccatcgatcgagataccaaccagaaactcatgttctttgagaaaggcacaccattcattattcaataaaatgccattcgtttgcaatgcattaaaaattcgtttttggcctgcatagcgttgttgatagtgaataactttacggaaaaaatccaggccagccagagtgggttcaccgccttgccaggtaaaatagacctgattgccagacgctgcgatatattgtttgatgaactctttcagagtgctgtcatccatccatttttcatgagtaaactgcgactctttttcaaggtaaaaacagtaatcacatttgagattacattgaaaactggagggcttggctgtaacgtgcatcgctatctcgctcaataaggcggcggaaaaatccgccgcatgaaggtttagttatttcgcttcgcttaatgctttcttgatattgttaaacttctcctgatttacctcgctaagcggtggctggctgttgtcgataaactctcttaccacgccttgcatctctttaacgacctgcggattggcggcggcaaggttatctttttgctgtagatccgtcagtttgtatagacctaactgattattttctactgtatagacgagcgaataatcgttatttctcaccgtataagagaattggcttaagtcctcggtgttggggttatgcgggtaatcgtctgactgatggcggacaaatttgtggtaattatcccagaatggaatattttcctcatcaaaccagtgagaataagatgttatccaggtcagatttttatgtggctcgccttgtttcttatcttgcaaccagggcagcaaggaaacgccatccagcttaaggtcttttggaatgctgatatcggctgcatcaagagctgtcgggtagaaatccattgcggaaatcagcttgtcataattaccgggttgaagttttcctttccaccacataaacattggggtgtgagtaccgccaggataggtctgactcttatagcctttttgcgccccgttcagcggcagaggaccatcgataactgcaccattatcggaggtaaagagaataattgtattgtcatactgtccgtttttcttaagttgttcgagaatgcgttttacaccctgatcaacagaataaacggaagcgtagtaattatctgctgtttgactaccggtattaaattgcttctgatattgctccggagcaggattatcatttggcagatgcggagcattataagccaggtaaagcataaaaggctggtcaagtgttttggcacgatcaacaacgccaattgcctcatcggttaactgatcgctgatataaccttttgcggggacgcgttcacggtttttgaacagtgaaggggagttgtaatatgccgttcctgcagcatggaatcccataaagtaatcaaagccacggttttgcggttgccattcttccgcagaaaaggtagtgaagttgtcatgatagtcacgcgtttgtttatcttccggcactggcacattactgatttttgacaagtgccatttacctactgctgcagtgtaataaccatgattctggaataattcaggcaagaaagtttctgttagcggaataccatcctgagcatcagtattggaatagacaccaaagcgggcgggcgctcgaccggtcattattgcggcgcgggacgggccggaaacaccgtgcgccacatagccgttagtaaaacgtacgccttcatccattaatgaaaggagcgtcggcgttgatttttgcgcagcttcaatggctttatctatccctattttgtaggtatcgacaacttcacgattttccattgtttttgggtcaaaagatcccttatcaaaaggaagctgtccataaccaagatcatccatggtcagtacgataatatttggctttcctttggtactgtattcagtcggcgtaaagtctgagaaagcaacgtttgttttggttgctttcagctttacatcatctgccgcatgagcagcaaatgcagccataccagatgccagtatcaaagatatcgaggtacttacgatacttttctttaatgcagacttcataaatgttcctcttcttattgtacttaattccaaagtaattttacgaagagaaataagttaatgtaagtgaagttagtcacataaatagatagcagatttagctaaaaaaagagaaataacagtccataaactgttgacattactttctgttctactaagtaatttctcgttgataaacaactaatctattgatatttaacaaattattgaattttaccgacaaaataccgaattgagatcataaataatcatgcaacgggttatgcaaatgcataaatatgtgaaggctgtcacttatttatttcaagaaatatatcacctaaaaacaacgcggggcagggaatgtctgccccatttaattcttacgcagcgtgtgtggttgactactcgttagcaaataatcaaatagctaaagcactcatcttgttatccgtgttcatacccgtgtgcctttgacaacggtactccttagaaactctctttggactgttgccgaaatgtttgcggaacgcataaataaaataagatgtactcgcataaccacattgttcggcaattttattgactgaaccttctacgcgtatcaaattttttgcgtgctgcattctggcatctaaaagaatctgtgagaatgtcgtttgctcttgctttagttttttcttcaacaggctttcactgatgtacaggcagtcacaaatatctttcagcttccatgggtgcgccagcttcatgttgacaatatttctcactttcccggaaacggatagcacaccgttagttaatagtgtaatgaaacctttgcatgcggcaaaaatagacaggcaagaaaaaagcaaaagttctgaaaaattatgatgattgcgttcttccgagttgagataagcaatcatttcattaagcaatccagtcggtacatttgaagcacgtaaaaacttcgcaggaacaggcatcgtcactgtctggatgttagtgcattgtagatattttttaatggtattttcattaaatccgatttctttgaaatgccgctcataaggttcaaaatgcgtacgaacagcgttatctaccattaggatctcgccgtcagagaaggcgtaatctttatctaaaatgttagcgttgaaggcatgatgaataaatataacagaacaaacgagcgacattttatctccttaaaacaataaagtttttatcgatacttttttaacatttcatatttataatttgctgtttgtttttcagtcttgcaaactattgataatgaaatgtgtaagatcccttgcaatgcgacccatttctgaaatacccagctgatcaattgccaaaaaaatggctatcaatgtaagggtcagtaataagacaaccacaattacagacatgatccctttatagttgtctctttgcgtgattttatttttcactatggtcgcatgcatttcaaatgtgtttattaaacgaatgacgttaagcatcgttaatcagtatgcttaatataacaggctggagaatagaggaaataggacgggtacttcagtactgagcggagtttcttacagctgtaggcagaagtttatatcttatagtgtgtggtttaatttaatccatgtgagcaaattgcgcgataatagtcaatgaggaattcttctgctgtgcggatgacagcagaagaaatgaggaggcgaattaatttgatggttctaattcaaccggaatacttttatagccaggaatgccacttaatggatcgtggttatcaagtgttagcatgtgattcgattctggaaaataggtcaccagtgagcggtcagccatagggtaaatgaccacttttaatctatccatgcggcgtgagctacgtttaccgtctggcgtgagtgcaataagattaactctttcgccgttttttacacggcaaattttagcttgtttagcactcataaagaccacatctcgttgaccgaatacccctcgatagcgatcatccataccataaatcgtcgtgttgtactgatcgtgactgcgtactgtcgccatgaccagcttactgttaaacgctgaagagggatcttctaacagccctttactggtaatgaaattagccttacctgacgacgtcatccagcgcctttcagctgctgcgtttatcaggtgaaaaccaccaggatgacggatgcgctggttatagtcggcaaactctggcagcacagcttcaatgtcattgcgaatgcgatcataatcttccaccagatactcccaggctaccacgctctggggtagtgctgcttgcgcgattcccgcgaccactgcacactctgatttcagcattacaccggcgggttttaacacaccacgcgaggcatgaatcatcgacattgaatcttcaacggttaccgcctgcgcaccgcttttttgcatgtcaatctcgctacgtcccagaaccggcagaatatagctatgccgtgcggtcagcagatgagagcggttaagcttagtggctacgtgtaccgccagatctaattgcgttaacggtacagcgctcgcttcccgatctggcattgccagtgcaaagttgccccccatgcagatcaatgctcgagcttgccccgtacatatagcttgcatgctggcgattgcagcatgtccaggtgcatgaggtggggtgaagccatagcgctcacccaggcgatccagaaactctgcagacggtttctcggtgataccgacggttcggtcgccctgtacattagagtgacctcgtagtgggcagatacccgcaccaggcttgccaatgttacctttcatcaacagcagattgaccagttgctgtacgttctgggtaccatgttcgtgctgagtgatccccattccgtaacagataatagttcgttcggcagcggcatatgcatcagcaagttcggcgatttgtgtctgacttagtccagaaatacgttcgatatctttccactcggaattgagcacgtcacggcgtagctcgtcaaagccgacggtatgcgtttgaataaattcgtcatccagcaatgagggccgacctgcggcgcttgcagcatcatcgcgctcaattaacaggcgcatcatccccttgagcaatgccatatcgccaccaatgcgcacgttatagtaggcactggccaactgagtctcagagttcgtcagcatttcaaacgggttttgcggtgcggtaaatcgctccaggccacgttcctgtagagggttgatagcgatcattttcgctccccgtttcactaaagcgcgcaacgaagtcagcatgcgagggtggtttgtaccagggttatgcccaatgcaaatgactaaatcgcatttctcaaagtcttccagcaacacggtccctttacccacaccgatactcgctgccaatcccacactggtcggttcatggcacatgttggagcagtcgggaaagttattgctcccgtattcacgggcaaaaagctgataaagaaaggcagcttcattggaagtgcgccccgaagtatagaattcaacctgattgggatcactatagctttgaaggcgagcgccaatttcgtcaaaagcttgttgccagcttaatggcttgtaacagtcgctgacgtcatcatatttcaaaggctgagtgagacgtcccgcagcctcaagctcgtgatctccccaggtaagtaatgattgaaccgtattctcagcaaagaaagaggcatttacctgcttatccgtgacttcccaggcgattgcttttgcgccgttttcacaaatgtcgaatgacgcactgtgcttaggatctggccatgcacatcccggacagtcaaagccctctggcttattcatgtcaaacatggcaataacatcctggcgtatatccatctgcttacgtactgcattcgctacggatttaacagcaccccaaccaccggcagctccctggtagaattcaatttttttcttcatctgcttatcctgtgtggaaatgaattattaggatttgtaatagcgatgatgcaaagtatatacaaagggtttatcgtcaacatgaatatataagagtaggggactactctcttactatttttactctattatcgttaaataatagagtagtataaatacgataagttaagcatcatctctcatagggtttaaattaacataattctcaatataaaaaataagactctggcttcaattgtgcgcggattttcttacaagtgtaggataatagccttcacaaaataattatccgcgcaattttcgtgaatggagcgcatagactaatgtcaaaatcacaattattcatagataaaagtgacaccaatgactgactggacggctccggctgcaaccttgtttcctgtttgtccataggttgcgcttaaacccagaggtactttgcttttatttactgtccccagggagacattttctcctgttgccagtgtttttccattacgcatcagagagacacccacgcccgatgcttttgttgcatctggtgctgtgttagcaaacacttgtcgggcactgtcagtggtggcacccgaaagataaaatgagagcttttgttcgctagagcaatatacactaaggggtatttctgcgcttccaggaaagtccgggagattcacggtgacattacgactatcgttccttagcgacagattgctgtctgctggttcagcaaggttccaggagagactacaggaagcttgtaatcgacaatacagtttgagtttttatcattgccccatgaaacctgtaatttccctgactgtggaagtccagtcagataaacctgaccattttccgcgacaatgctgccatttttattctctccgtgagtgacaattgcaccgaatggaacgcttttattaccgtacttcaacgtcattaatactttcccgccgatttgtgcattaaatgttgctctggcaatagcaccgtgagttgggatgacagtgactacggtttcatccagttcaacattatctgcaagggaattcgcgttaagagcgacacgattttctctatattctgtcgcaaatggtaatatggcatagccacgccagtcggtatgaattccggtctggttctctattttgacattatcagcgccagtagccttaaccagaaccattgtgtcgcccagcggctgtccaaaggtgatgccatcagcatgagcaataatcccaccactcattccgtaataaatctggctgctgtcaccactccgactgtaaccgacattcgtattagcgtaagctccacgataattaagagaactgtaaccactggtgccagacgatgtattacccccttgggtgttaccgacctgaacgctataattcaggttattatccggcagcagagtgccatatgtacgcatccaatgactaaagggaacattaagcgtaaaagcgagtaaatgatcccgatcgttttgccatatattattggaatagctgtaattcagcgaagtcgtaatatcaccaaacggcacatttaatccaaatgatatttgctggtcgctgcgtgacgtgttccagtaactttggcgactggcactgaaaaatgtcgtaccgtaatctgaatgagatagacactggcaggatcattattcgtgacaggcaataaaacctgtttctggtttgccggataaattacccgcgtcgcaccaagtgcgacagctgcgttggcaatggtgctatggcaagcaaagagcaataaaagtaacactgtcgccataaaggaaacagagtagggggtacgcgtagtttgcatctgatgcattctccatgtgttaagaggataagcggggaaaccgttacatcagacaatcggtaaatattgctaatacattggcgagtcgccgggtttccagacttaatgcgtttgtaataaatgttggttctcttttgataggaaaaccttgctaccaagtaaatattttaaataacagcaagtttaactactgttgtttattgatcggcttgacctgaagtaataacgtcgaccggaaaatcactctgcatcactcaaattcaatttaacataatatacattatgcgcatcaacataaaccaagggagaatccagtcgttggcggttcatgattgttctgctcattaacaacgaccaaaaccccatatcttacttaataccgtattctcggcttaaccgaccgtgcaacctcaacacattggtttcaactgccgtcaccacgttctccggaaaatctgtcggtaatgaagtcttcacgttatccagtgctgccggaatcattctggcaaagtcactcaggatttcatgcatctgcacttccgggaatttcagcacctttgctgtcgccagaaaatgtcgcggataaattttatcgattgccgtttttttgcctttggatgcgttaagccccattgccagtttgagatcgctgatgtgtattcccgtaccgccaaggaccggaaatgccgaaatgatgtcataaaatggtgtgagccgataactgccgccagcctgaataaatacggagaagttttttgcatggccatctgttgcgccaatcaaccactggaagacctgaaacttcataaaatcatagcgatctttcagcgcctcgctggaccccatcaaaaaagccataatttgcgcgataccggggcctccatctgattcatatttcaccgatgaaggtaaaccgaatgtctggcacatatcctcctgtggcaagcgaagtaaaaccgttcgctcagtattccaacgcctgtcaaaacgttcgaccgctaacgcgcgcacccttcccgctttaatgatttctgcgtccggaacattcaacccgagttctttcgccagcagcaaacagtaatactcattatcaacactttggctaagatcgagcgtcgcattgggctgtctgatttcgccaatcggcaatttgataatgtgcgtcgttggcgttattcccttcggaatgcaccagtcattgcctattctgagcagcgcagtcttctcctgtgcgccagcaaccgagatgcgaaagtcattttcttctctaatcatgcctaacgggatatctgctttataagccgttaatacttcttcaagtctggcttcagtaagcttttcccatgccattatcggacacattacggtttcatcttcggggattaacgtcacggcaccaacgctgtctcgccctatttctgacaataaatcaaacggttgtctggatttagcatgataacgtttaacgatccggtcacgtacaatcgggctatcgggtaacaggttatcgaagaagttaaatacggcatcagaggtgatattccccctctgcaatggcagcgaaagtgacaacggtctggcataacggctggctaaccactcaggtgcatacttaaaggtgtgcgcgccgttggctaacttcgttaactcgcctacccgctggttgttcatccaagtgactagtttaggcatcaccactccagatcttgctgttctgttgcttctggcgaggcattttttgcgtcgcatagcgtcattgagagttcaagcgactgtaaaatcttaaaaaatgtcgtgagcgaggtattgtcaggattgttttcgaaattggaaattgtcgcctgcttaatgccgatttttttcgccaattcgctctgcgtccagccgttttgctggcgaaccagtttcattgcattcgccaattgcattgggctatagatcttctgaaagctcatcatgtcatacgtccacagcaaatttatccgcttaaggggatattatcagttttatcctttagtgaggataaagtcaatctggaaacacatcttatccgctctacgggataaacgctgcgatatccgcgatcgcggataaaaaggaggatttaaaaatatcgattgggtgaccgccactggattacgtccgtggttacaggatctgaccgagagcgaacagcagcattttcttacgcgctaccatcagatgctggaagagcaatatcccctccaggagaacggacagatattgctggcatttccgcgtctgtttattgttgcccgccgtacggagtaattatcacgtcagctggtaatggcgatcgggaagaattttcgctggaatttctgcttcatcattcatctgtaacaggtcaatttcaatagcgttgcagatggcatccagcggtaaatcattgttttcagtaccgaagggatcttccagttcttccgccagacaatccagcgaaataaaagtgtaggaaatcagcacagagataaaaggcgtcatgtaatgcaggtccacgaccagcgcaaacggcagcatgatacaaaacagatacacggtgcgatgcaaaatcagggtgtaggcaaagggaattggcgtataggcaatgcgctcgcatcctgccaggaccgctgaaatatcattaagccgatcgttgaggctaataaacaggatatctgaaagttgtccattgcgtcgctgaaccgccaaccactcccccattattaacaagatacggttagctggagagttcgaagccagtacacgctgaagatcttcagtcttgagataatgagccagcacttccgcctgtggctgtttgcgtaatgtcatgcgtaaacagtgggcgaaggcgatttgcagccgggcaaactcccttacacttgccgaatccggcaatgtcgtttttacctcgcgcagtaacgaccgcgaggcaatcatcaactgaaaagagaaaattgagtagtaagcgcgaggatatcttgaataatactgaaccgtgccagacaaaaatacggcgcagccagtgttgttgtggacgaacaatcatggttatcttcaggcgtggaaaagtcgccctattaaacgtgattacgatcacattctcaagacattacttacaaattacctacaagcttacaacattaacaggtgctgcatgtggcacctgttaatgataaagacgcataggatgttgtaactaatatagtgaaataagaaacccggtcgaaaccgggttcagagtattagcacaacgggcgtacagcttcgcgcatccctttttcgagaatcgcatccaggtcattagcaacctgctcgaccagaccaggcacttgcgtcaggtcctgctcccagtggtctttttctgccaacacaatcgctaccagttcctgggtcccgataacacggtcacgatactggctccagagttgctgataacgttccagccagtgtgcatcgtcctgtaccggatatgtttctccattacgctcaccgcgatagaacgcaatcaatgccgctaatgcgaaagtaaggcgcgccggaagtgtgccgtttgccttctgccctgccagcagctgcggcaggatgcgtgtgcggaacttggtcataccgttgagcgcgatagacagcagttgatgcttgatgtacgggttacggaaacgtccggtgactgcactggcgaaagactccagctcatcgcgtggcaaatccagtaccggaataatttcttcgtagatggctttttcaacgaatgcgcaaatttcagcatcgttcatcgcttcacctacggtatccagccctgcctggaacgccaccggcaccagcgcggtgtgcgcaccgttgaggattgccactttgcgttctttatacggtttaatatcgtcaacgatcagcacgttgagcggatatttgtccagacgaagttcagtcgctaaggatttcggcccctgaatcacaaacaggtaaaagtgttcagcggtgtcgaggaaaccatcgtggtagcccagttcttcttccagtttagccacttcatcacgcggataaccggtaacgatacggtccaccagcgtagaacagaagctgttagcctgatccagccattgaataaatgcttctggcagtgcccactcttgcgcatagcgcagcaccagttcacgcaacgcgtcgccattatagtcaatcaactcacacgggatgatgatccaacctttatccagcgcaccgttgaaatggctaaaacgttcgaacagcagacgggtcagttttgccggataacttaccgctggcgcgtcatcgaatttatcgcccgcatggtagctgatacccgcttcggtggtgttagagaaaacaaagcgcatttccgggttgtgagccagtttcaggaattcatcgtattcactgtagacgctgatttcacgattaaccgagcgaatcagacgcgcgtcgctgaccgcttcacccttctcattcaggccacggataatggtggtatacagaccatcctgcgtgctcagtgacggcgggaatgaagtttcaatcggacgaacaacgaccacgccagaattcagatcggtgtgctcattcaggagatcgatttgccagtcaacaaaggcgcgcaggaagttaccttcaccaaactgaatgatacgttctggatactgtgcaccgggaaaatcgcgacgaacttgccgcaagatgttttctaaaattgcattatccatggcgactgccactttctactcctggaccgcaggtctgaaaagacctgcgagtatatcagagctgaatatatagcgtcagacccggtctttccataccgtctgaatattacagaattcgtgtaagccgaaatgggaaagctcacgaccaaagccactcttcttcacgccaccaaaggcgactcgcgcatcgctggcacaataaccattgataaataccccaccgcattccagacgtgccgccatctgtctggcctgtgtttcgtcggtggtgaaaatggtcgctgaaaggccgaactcactatcattagccagttccagcgcatgttcagcatctttcgcaatggtgattgccgcaacggggccaaacatttcttcccgaaacgcggtcatttctggggtaacattcgccagaaccgttggcggatagtagttacctgctccagccatcttttcccctcccagtaacaaacgcgcaccctgcgccagtgttttttccacctgatgatgcagctcatcacgtaaatcaaaacgagccattggtccgagagcgttctcttcatcacggggatcgcccattttcaaggctgccgcagctgccacaaaacgttcggtaaatgccgaagcaattccctcttcgatgataaagcgttttgccgctgcacaaacctgtccggtattctgataacgtccggctaccgccgctttcaccgccagttccagatcggcatcgttaagcacaataaacggatccgaaccacccagttccagtacgcattttttcagtgccactccagcctgtgcgccaatagccgctccagcacgaacacttccggtcactgtgacagcagcaatgcgcgagtctttaatcatcagactgacaccgtcgttgtcggcattcagccagccatatacgccttgtgggatacccgcatctttaaacacctgggcaatgagctgtgcacagcccatcacattcggcgcatgtttaagtaagtagccgttaccagcaagaatgatgggaacagcgccacgcatcacctgccataacggaaaattccacggcataatcgccagaatcgtccccaacggtcgatactcaataaccgcctgctgattttccaccagcgtaggttctgccttcagcattgctggaccatgttctgcataccagtcacacaaattcgccgatttcgccacttcagcgcgcgcctggttgattggtttgcccatttcacgggtgatcatttgcgccatttcttcgctacgggcgcgcagagccttaccgatatcacgcagtttttcagcacgataatctatatttgcctcgcgccagtcgcgaaagcctgctgctgccagctgaagcgcgttttcgatatcgtcaacaccagcccacggcagcacagaaagttgttcaccggtggcaggatttatcgaaattgcatgagttgccggagtaatggtcatcggggtatctcctttatgagtcatggtatgaagatacgcagatttactcttgctttaaaatgaataatattaagccacttattcacgaatcgagaatgctatggatctgacccaactggagatgttcaacgcggttgccgaagctggcagcattacccaggctgcagcaaaagtgcatcgcgtgccgtcgaatctcactacccgtctacgccagctggaaacagaactgggggttgatctgtttattcgcgagaatcagcgtttacgtctctcgcctgccgggcataactttttacgctatagccaacaaattctcacgttagtggatgaagcgcggagcgttgtcgctggcgatgagccgcaaggtttattttctctgggatcgctggaaagcaccgctgcagtgcgcattccggccacgctggcggaatttaaccgtcgttatcccaaaattcagttttcactttccaccggcccttccggcactatgctggaaggtgtgctggagggaaaactgaatgcggcgtttattgatggacccattaaccatactgccatcgacgggataccggtataccgcgaggaactaatgatcgtcacgccacaaggacatgcgccagtaacccgtgccagtcaggtgaatggcagtaacatttatgccttccgcgccaattgttcgtatcgtcgccacttcgaaagctggtttcatgctgacggtgccgctccgggaactattcacgagatggagtcttatcacgggatgttggcctgtgtggtcgcaggagcaggcattgcgcttattccacgctctatgctggaaagtatgccggggcatcaccaggttgaagcgtggccgttagctgagcaatggcgttggttaacaacctggctggtctggcgtcgtggtgcgaaaacgcgtccgcttgaggcatttattcaactgctggatgcgcctgactcggcaaaacagggttaccaatgagctatttttgatagttcatgcggataatatgctctatatagtgatgttccgatgacttatgactatatggggcaaatatggttacgccagtaagcatcagcaattacatatctcttcctgatgattttcccgttcgtaatattgcacctcaagtaaaagaagaacaggcccccttcctgatcgtcattaaaatgtgatgttaacaactctctgatgcgtgacagaacaaccgtcagagagatggaaatgcgatccagatcacaaatgcattgtattcacatcattaaccgttttaagatcatttcatcactttttcgcaactcacccgataatctgttatgacaacaaacactgtttcccgcaaagtagcgtggctacgggtcgttacgctggcagtcgccgcctttatcttcaataccaccgaatttgtccctgttggcctgctctctgacattgcgcatagttttcacatgcaaaccgctcaggtcggcatcatgttgacaatttatgcatgggtagtggcgctaatgtcattgccttttatgttaatgaccagccaggttgaacgccgcaaattactgatctgcctgtttgtggtgtttattgccagccacgtactgtcgtttttatcgtggagttttaccgttctggtgatcagtcgcattggtgtggcttttgcacatgcgattttctggtcgattacggcgtctctggcgatccgcatggctccggccgggaagcgagcacaggcattgagtttaattgccaccggtacagcactggcaatggtattaggtttacctctcgggcgcattgtggggcagtattttggctggcgaatgaccttcttcgcgattggtatcggggcgcttattacccttttgtgcctgattaagttacttcccttgctgcccagtgagcattccggttcattgaaaagcctcccgctattgttccgccgcccggcattgatgagcatttatttgttaactgtggtggttgtcaccgcccattacacggcatacagctatatcgagccttttgtacaaaacattgcgggattcagcgccaactttgccacggcattactgttattactcggtggtgcaggcattattggcagcgtgattttcggtaaactgggtaatcagtatgcgtctgcgttggtgagtacagcgattgcgctattgctggtgtgcctggcgctgctgctacctgcggcgaacagtgaaatacacctcggggtgctgagtattttctgggggatcgcgatgatgatcatcgggcttggtatgcaggttaaagtgctggcgctggcaccagatgccaccgacgtcgcgatggcgctattctccgggatatttaatattggaatcggcgcgggtgcgttggtaggtaatcaggtgagtctgcactggtcaatgtcgatgattggttatgtgggcgcggtgcctgcttttgctgcgttaatatggtcaatcatcatttttcgccgctggccagtgacactcgaagaacagacgcaatagttgaaaggcccattcgggccttttttaatgatacgttttaatgatttccaggatgccgttaataataaactgcacgcccatacataccagcaggaatcccatcagacgggagatcgcttcaataccacccttgcccaccagccgcataattgcgccagagctgcgtagacttccccacaaaataaccgccaccaggaaaaagatcagcggcggcgcaaccatcagtacccaatcagcgaaggttgaactctgacgcactgtggaggccgagctaataatcatcgcaatggttcccggaccggcggtacttggcattgccagtggtacaaaagcaatattggcactgggttcatcttccagctcttccgacttgcttttcgcttccggtgaatcaatcgctttctgttgcggaaagagcatccgaaaaccgataaacgcgacgatcaaaccgcctgcaattcgcagaccgggaatcgaaatgccaaatgtatccatcaccagttgcccggcgtaatacgccaccatcatgatggcaaatacgtacaccgaggccatcaacgactgacgattacgttcggcactgttcatgttgcctgccaggccaagaaataacgcgacagttgttaatgggttagctaacggcagtaacaccaccagccccaggcctattgctttaaacaaatctaacattggtggttgttatcctgtgtatctggtttatcagcgaaaagtataaggggtaaacaaggataaagtgtcactctttagctaaccttgcatcgcattgaccaaaacttgaaccgatttagcaaaacgtggcatcggtcaattcattcatttgacttatacttgcctgggcaatattatcccctgcaactaattacttgccagggcaactaatgtgaaaagtaccagcgatctgttcaatgaaattattccattgggtcgcttaatccatatggttaatcagaagaaagatcgcctgcttaacgagtatctgtctccgctggatattaccgcggcacagtttaaggtgctctgctctatccgctgcgcggcgtgtattactccggttgaactgaaaaaagtgttgtcggtcgacctgggggcactgacccgtatgctggatcgcctggtctgtaaaggctgggtggaaaggttgccgaacccgaatgataagcgcggcgtactggtaaaacttaccaccagcggcgcggcaatatgtgaacaatgccatcaattagttggccaggacctgcatcaagaattaacaaaaaacctgacggcggacgaagtggcaacacttgagcatttgcttaagaaagtcctgccgtaaacgaaaaaagaggtatgacgatgtccagacgcaatactgacgctattaccattcatagcattttggactggatcgaggacaacctggaatcgccactgtcactggagaaagtgtcagagcgttcgggttactccaaatggcacctgcaacggatgtttaaaaaagaaaccggtcattcattaggtcaatacatccgtagccgtaagatgacggaaatcgcgcaaaagctgaaggaaagtaacgagccgatactctatctggcagaacgatatggcttcgagtcccaacaaactctgacccgaaccttcaaaaattactttgatgttccgccgcataaataccggatgaccaatatgcagggtgaatcgcgctttttacatccattaaatcattacaacaactagttgataacgtgacaacgtcactgaggcaatcatgaaaccacttttatccgcaatagcaactgcgcttattctcttttctgcgcagggcgttgcggaacaaaccacgcagccggttgttacttcctgtggcaatgtcgtggttgttcccacatcgcaggaacaaccaccgtttgatttaaatcacatgggtactggcagtgataagtcggatgcgctcggcgtgccctattataatcaacacgctatgtagttattgtcaggctctgatcacagagcctgacatttccgtaatatcttcctgaagtctcatatattttcgccattgttggcgatgagatcccgataccagtaaaacgatgctttacgtatccgttccagcgttcccttcccttcgttgtctttatcgacataaatcattccgtagcgttttttcatttctcctgttccggcagaaaccaggtcaatgcaaccccacggggtgtagccaattaagtcaacaccatcttcaactacggcttttttcatttcccgaatatgggaggaaaagtaatcaatgcgatagtgatcgttcaccgtgccgtcagcttgtctctggtcaaccgcaccaaatccattttcgacaataaacagcggcaactggaaatgatcccagaaccagttgagtgaataacgtagccctgccggatcaatttgccatccccattcggatgtatcgatataagggttgctgaccaaatctcgtggttcaacataatccagttgcggattatctggcgaaaattgcgtcgtaaaagacatgtagtagctaaagccgataaagtcgacacaacctctggcaagaatcgcgttatcatctggtgtgatatcgaggttgaatcctttccttgcaaagtaattcagcatatgttgcggataatatccacgagcatgaacatcagtaaaccagtaacgacgatgcatcgctttcgtggccatcatcatatcgttgggtgcacacgtcagaggatagatggggcacatagcaatcatacagccgatattaaattcaggattgatcagttttccagtctgtaccgccagggcactggcaactaactcataatgtaccgcctggtacattatttgttcgcgctcattgagatcttcctctggcgaatacaagataccggaattagtaaatggacacaggctttcgctgaaattcacctgattattgatttcgttaaacgtcatccagtactttactttttctttatagcgcgtgaagaccgttgatgcgaagtggataaaaaagtcgatcagtttacggtttcgccagccaccatattttgtcaccagatgataaggcatctcaaaatgcgaaagcgtcaccacaggttccattccctgcttcaggcattcatcgaagagatcatcataaaattgtaaaccctcttcattcggctcctgttcgtcaccttgcggaaagattcgtgtccaggcaatggaagttcgaaagcatttgaatcccatcccggcaaataactgaatatctgttttatagcgatgataaaaatcaattgcttcatgattgggataattaagtccgtcgataacgccttctgtcacttcacgcggcaccccgtgagcgccagcagtcattacatcagcgatactgatgccttttcctccttcattccagccaccttccaattgatgtgcggctaccgcaccgccccataaaaaatcttctttaaatcctgacatacacaactccttaactaaatagattaccaccagacttccgcctggatgccggccataaattgcgactgagctgaatttagtgactggtgagcaggtttattacataaagagactgcgattcattgaggataatgcagcacaattagaagaaacgtggatgtcagtggcacgttttcctgatttaaccgtatcgcatatgcaaaaatccaaattttcgtatattgagaacgaatgcgggatcaaaatcattggcacctttgaaactttctccccgacttttcctaccccagaaatcgccagtattttacggatcagcccacgggatcccatacttaaaattcagacccaggctgtggatagtaactctattccgctggattattcgttactttacagcaatattttcgagttccaggtaaagtactttttcccgcgataaaagcagacgcacagagtgctggcatcacattctgtgcgtatggtttagcctctgacctttaccgctttacgccaccgcaagccaaatacattgatatacagcccggtcataatgagcaccgcaccgaaaaattgcagacccgttaagcgttcatccaacaatagtgccgcacttgccagtccaactacaggcaccagtaacgataacggtgcaacccgccaggtttcatagcgtcccagtaacgtcccccagatcccataaccaacaattgtcgccacaaatgccagatacatcagagacaagatggtggtcatatcgatagtaaccagactgtgaatcatggttgcggaaccatcgagaatcagcgaggcaacaaagaagggaatgattgggattaatgcgctccagattaccagcgacatcaccgccggacgcgttgcgtgcgacatgatctttttattgaagatgttgccacacgcccaactaaatgctgccgccagggtcaacataaagccgagcatcgccacatgctgaccgttcagactatcttcgattaacaccagtacgccaaaaatcgctaaggcgatccccgccaattgtttgccatgcagtcgctcaccgaaagtaaacgcgccaagcacgatagtaaaaaacgcttgtgcctgtaacaccaacgaggccagtccagcaggcataccaaagttaatagcgcagaacagaaaggcaaactgcgcaaaactgatggttaatccataccccagcagcaaattcagtggtactttcggtcgtgcgacaaaaaagatggccgggaaagcgaccagcataaagcgcaaaccggccagcatcagcggtggcatgttatgaagccccactttgatgaccacaaaatttagcccccatacaaccactaccagtagcgccaacaccccatcttttcgcgacattctaccgcctctgaatttcatcttttgtaagcaatcaacttagctgaatttacttttctttaacagttgattcgttagtcgccgattacgacggcattaatgcgcaaataagtcgctatacttcggatttttgccatgctatttctttacatctctaaaacaaaacataacgaaacgcactgccggacagacaaatgaacttatccctacgacgctctaccagcgcccttcttgcctcgtcgttgttattaaccatcgcacgcggcgctacgctgccgtttatgaccatttacttgagtcgccagtacagcctgagtgtcgatctaatcggttatgcgatgacaattgcgctcactattggcgtcgtttttagcctcggttttggtatcctggcggataagttcgacaagaaacgctatatgttactggcaattaccgccttcgccagcggttttattgccattcctttagtgaataacgtgacgctggtggtgctcttttttgcccttattaactgcgcctattccgtctttgctaccgtgttgaaagcctggtttgccgacaatctttcgtccaccagcaaaacgaaaatcttctcaatcaactacaccatgctcaacattggctggaccatcggtccgccgctaggcacgctgttggtgatgcagagcatcaatctgcccttctggctggcagctatctgttccgcgttccccatgcttttcattcaaatttgggtaaagcgcagcgagaaaatcatcgccacggaaacaggcagtgtctggtcgccgaaagttttattacaagataaagcactgttgtggtttacctgctctggctttctggcttcttttgttagcggcgcatttgcttcatgcatttcacaatatgtgatggtgattgctgatggtgattttgccgaaaaggtggtcgcggttgttcttccggtgaatgctgccatggtggttacgttgcaatattccgtgggccgccgccttaacccggctaacatccgcgcgctgatgacagcaggcaccctctgtttcgtcatcgggctggtcggttttattttttccggcaacagcctgctattgtggggtatgtcagctgcggtatttactgtcggtgaaatcatttatgcgccgggcgagtatatgttgattgaccatattgcgccgccaggaatgaaagccagctatttttccgcccagtctttaggctggcttggtgctgcgattaacccattagtgagtggcatagtacttaccagtctgccgcctttctcgctgtttatcatcttagcgttggtgatcgttgttgcgtgggtgctgatgttaaaaggaattcgtgcaagaccgtgggggcagcccgcgctttgttgatttaagtcgaacacaataagaatttaattcagccttcgtttaggttacctctgctaatatctttctcattgagatgaaaattaaggtaagcgaggaaacacaccacaccataaacggaggcaaataatgctgggtaatatgaatgtttttatggccgtactgggaataattttattttctgggtttctggccgcgtatttcagccacaaatgggatgactaatgaacggagataatccctcacctaaccggccccttgttacagttgtgtacaaggggcctgatttttatgacggcgaaaaaaaaaccgccagtaaaccggcggtgaatgcttgcatggatagatttgtgttttgcttttacgctaacaggcattttcctgcactgataacggatcgttgacacagtagcatcagttttctcaatgaatgttaaacggagcttaaactcggttaatcacattttgttcgtcaataaacatgcagcgattccttccggtttgcttaccctcatacattgccctgtccgctcttccaatgagcacatccagaggctcttcaggaaatgcacgactcacaccagcagtcacggtaatgttgatatgcccttcagaatgtgtgatggcatggttatcgactaactggcaaattctgacacctgcacgacatgcttcttcatcattagtcgctttgacaataatgataaattcttcgcccccgtagcgataaaccgtttcgtaatcgcgcgtccaactggctaagtaagttgcgagggtgcgtaatactacatcgccgattaaatgcccgtaggtatcattaaccaatttaaatcggtctatatccaacaacattaaataaagattcagaggttcagcattgcgtaactgatgatcgaaggattcatcaagaacccgacgacccggcaatcccgtcagaacatccatactgctacggatcgtcagcaaataaattttgtaatcggttaatgccgcagtaaaagaaagcaacccttcctgaaaagcgtcgaaatgcgcgtcctgccagtgattttcaacaatagccagcattaattcccgaccacagttatgcatatgttgatgggcagaatccattagccgaacgtaaggtaattcatcgttatcgagtggccccagatgatcaatccaccgaccaaactggcacagtccataagaatggttatccgttatttctggcttactggcatctctcgcgaccacgctgtgaaacatacttaccagccactggtagtgggcatcgatagccttattgagatttaacaagatggcatcaatttccgttgtcttcttgatcattgccactcctttttcacagttccttgtgcgcgctattctaacgagagaaaagcaaaattacgtcaatattttcatagaaatccggagttatgagcatctctgagataacattgtgatttaaaacaaaatcagcagataaaaaagtgtttaattctataaattaactctgcattatcgcaattaaaaggatgacaaatagcataacccaataccctaatggcccagtagttcaggccatcaggctaatttatttttatttctgcaactgagtgacccgaacgacggccggcgcgcttttcttatccagactgccgctaatgttgatcatctggtccggctgaatttgaaaattattataacggaagagtatacaaaaaaagtaattttgctggcgactgcgaaacggcattcgcattagcggtgaagtttgccctcgcccagttgctgcaattactgctataacgaagctggtctggcgataaatccaggccagccattggtggtgtttatacgttcaagccacgatgttgcagcatcggcataatctgaggtgccttaccgcgccattgtcgatacaggcgttccagatcttcgctgttacctctggaaagaatcgcctcgcgaaaacgccgcccattttcacgcgttaatccgccctgctcaacaaaccactggtaaccatcatcggccaacatttgcgtccacagataagcgtaataacctgcggcatatccgccaccaaaaatatgggcgaaataactgctgcgatagcgtggcggtatagcaggaagatccatattttccgccaccagcgcccgcaattcgaaatcatcgacgtcctgcattgcttcgttttcttccagacaatgccagcacatatcgagaagtgcggcgctaagcagttcgctcatctcataccctttattgaacaggctggcattacgcattttctgttgaagttcgtcaggcattgcggctctgctctgataatgccgggcgtagcgagcgaatacctgcggatgtgttgcccagtgttcgttgatttgcgacggaaattcgacaaaatcacgcggcgtgttggtgccggaaagcgtggcataacgctggcgggcaaaaaggccgtgcagcgtatgaccaaattcatggaataaggttattacatcatcccagagtaacaacgcaggctcaccggcagcgggtttctgataattgcagacgttataaattaccgggtgcgtttcattcagcgttgattgctcaacaaaattgcccatccatgcgccgccgctttttgaatcacgggcgaagaaatcaccgtaaaataacgccagccccacgccattatgatcaaaaatttcccacacacgaacgtcaggatggtagacaggaatatcaaaacgttcgacaaacttaataccgaagagctgattcgcagtccagaatacgccttcattcaacaccgtgtttaattcgaaataaggcttgagctgcgcttcatcgagatcgaatttctcacgtcttacctgctcggcataaaatgcccagtcccacggctgcgcgctaaacccgccctgctgcttatcgataaccgcctgtatggaggttaattcatcgctcgcacgttgacgcgccgctggaacaatttcccgcataaagttgagcgctgcttctggcgtttttgccatctgatcggcgattttccatgcggcataatgaggaaaaccaagcagtttcgcctgctgcgcgcggatctccaccagacgttgaatgatagcgcgggtatcattggcatcatttttttccgctcgcgtccagcccgcagtaaacagtttttcacgcgtcgcgcgatcgcgcagttcagcaagcgctggttgctgggtggtattcagcagcggaatcagccagttgttatccagacctttctcgcgagccgcctctgccgccagcgcaatctcttgttcactcattcctgccagctgcgcgatatcgttcacaaccagaccgccggatttatttgctgccagtaaccgctggttaaactggctggtcagggtcgcagcttctgtattcagtacttttaattttgctttatcagcttgctcaagtttggctccggcaaggacaaaacgttgatgaatcacctccactaggcggatggattcactatcaagccccagggattcacggcgttgccagacagcatctacccgcgcgaataattccccgttcagatagatatcattcgcaagttccgccagttcagcggaaaactgttcatcaagacgctgtaattcatcattggtatgcgccgcagtcatcgcaaaaaagacgctggtaacgcgggtaagtaattctccgctttgttccagtgccagaatagtattgttgaaatcaggtgtttgcgggttaagcgcgatggcagctatttctgcccgcttttgctgtattccctcatcgaatgccgggcgatagtgatggttggcaatttgatcaaaatggggagccagatacggcagtgtgctttgcacaaggaaaggattcattgttgtcattttcttctcctgaacgcgaggtgttccatagcgtaggcttactgataacggagtgcaatcttgcaaaccagtattacccgctcttaagcatcacgtgctatgttattgacacacaaaagcgttgaggaacagtgagatgatcgttttagtaactggagcaacggcaggttttggtgaatgcattactcgtcgttttattcaacaagggcataaagttatcgccactggccgtcgccaggagcggttacaggagttaaaagacgaactgggagataatctgtatatcgcccaactggacgttcgcaaccgcgccgctattgaagagatgctggcatcgctccctgccgagtggagcaatattgatatcctggtaaacaatgccggcctggcgttgggcatggagcctgcgcataaagccagcattgaagactgggaaacgatgattgataccaacaacaaaggcctggtatatatgacgcgcgccgtcttaccgggtatggttgaacgtaatcatggtcatattattaacattggctcaacggctggtagctggccgtatgccggtggtaacgtttacggtgcgacgaaagcgtttgttcgtcaatttagcctgaatctgcgtacggacctgcatggtacggcggtgcgcgtcaccgacatcgaaccgggtctggtgggtggcaccgagttttccaatgtccgctttaaaggcgatgacggtaaagcggaaaaaacctatcaaaataccgttgcattgacaccagaagatgtcagcgaagccgtctggtgggtgtcaacgctgcctgctcacgtcaatatcaataccctggaaatgatgccggttacccaaagctatgccggactgaatgtccaccgtcagtaatttttatacccggcgtaactgccgggttattgcttgtcacaaaaaagtggtagactcatgcagttaactcactcacaagcaagaacgaatgaccgtcgaaacgcaacttaatcccacacagcctgtcaatcagcagatttatcgtattcttcgccgcgacattgtccattgcctgattgcaccaggcacaccgttgtcggaaaaagaagtttctgttcgtttcaatgtgtcacgccagccggttcgtgaagcctttattaaactggcggaaaacggtctgattcaaattcgtccgcagcgtggcagctacgtcaacaaaatttccatggcccaggtgcgcaacggcagttttatccgtcaggccattgagtgcgcggtggcgcgtcgggcggcgagcatgattaccgaaagccagtgctaccaactggaacaaaatcttcaccagcaacgcattgccattgagcgcaagcaactggatgatttttttgaacttgatgacaacttccatcaactcctgacgcagattgccgactgtcaactggcgtgggataccattgagaacctgaaagcgaccgttgatcgcgtgcgctatatgagtttcgaccacgtttctccaccagaaatgctgttacgccagcatcttgatattttctctgccctgcaaaaacgtgatggcgatgcggtagaacgtgcaatgacgcaacatttgcaggaaatcagcgaatctgtgcgccagatccgccaggaaaacagcgactggtttagcgaagagtaattcatttcctctcatcccatccggggtgagagtcttttcccccgacttatggcttctgcatgcatcaaaaaagatgtgagcttgatcaaaaacaaaaaaaaatttccctccacaggaatatttatattgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcatttcaaaaaaattatcggttgcaatatcacgcggtgttgcttttatggacgatgccggatttgacgaagaggattttaaaaaacccatccgcgtccatttacccgttgtgaatgaccttccaccggaaggtgtgtttgatactgaattctgcaaccgatacgaaaaaggcggagaagatggtatcacaatgatatttatagcgccctccccctcagttcaggacaaaccagccagcactgacaataccaacgtcaatggcgaagacatggctgagattgaggataatatgctcctgccgatttccggtcaggaactgcccattcgctggcttgcgcaacatggcagcgaaaaaccggtaacgcacgtttcacgagaagaacttcaggcattacatatcgcacgagctgaagaactaccggctgttactggcctggctatttcccacaacacaaagctgctcgacccgctggagattcgcgaccttcacaaattggtacgcgacactgacaaagttttccctaatcccgttaattccagtctggggttcatgactgcttttttcgaagcatacctggacactgactataccgatcgaggtctgctgacaaaagagtggatgaaaggaaatcgtgtttctcgcatcacccgcacggcttccggtgcaaatgccggtggcggaaataaaaccgatcgtaatcctgacttagtacacaccctcgatactctggatgtggaggctgcagcagccacgcttccgatggattttaatatttatgaaattcccgggagcgtttatcgtcgcgcaaaagaaatcgtcctgaaaaaagaaagtccgttcagggaatggtccgcagcacttcgcgcaacccctggtatcctggactattcccgcgcagctatttttgcacttatccgaagcgcccaccctgagttttatcactacccggggcgccttcaggggtatatcaatgccaacctgacagaaactgatcacgagaatcccacagctgaaacgctcatggctgcccggcatacaccggaaaaagatatcctggaagaaattaacggcggactggctgctgagtgcaaaacagaagaagaaaaaaatgatgaagataacccgcagccgctggatgacaagtcacaggtaaaagttaccgctgacgaagtaaacaaaattatgcaggcagccaatatcagccagcctgacgccgataagttgcttgctgcctctcgcggagaatttgttgcagggattagcgacccgaatgatccgaaatgggtaaaggggattgaaacccgcgattctgtaaaccagaaccagcaagaatcggaacagaacgaccagaaagcggaacaaaacagcccaaatgcgttacaaaacgagccagaaacgaaacaacctgaaccagtagtgcaacaagaaccggaaaagatctgcaccgcctgcggtcagaccggcggcggcaactgccctgattgtggcgcggtgatgggcgacgcaacataccaggaaacattcgatgaagagaatcaggttgaagttcaggaaaatgatccgaaggaaatggaaggcgctgaacatccacacaaggagaatgctggcagcgctcaggatcacgccagcgatagtgaaactggcgagacggcagatcccttaattacggtgaacggtcatcacgttatcacatccaccagcaggttgtggcaccatctgatgattgaccttgaaacaatgggcaaaaatcctgatgccccgattatctcaatagatgcaatatttttcgatccgcaaaccggagatatgggaccggaatttagtaagactatcgatctggaaactgctggcggagtcattgatcgtgacgtcattaaaaggtggctgaagcaatcacgtgaagcgcagtctgccattatgaccgatgaaatcccgttagatgatgcactgttacaattgcgggaatttatcgacgaaaactccggtgaattttttgttcaggtctggggaaatggagccaacttcgaaaacacgattttgcgccgttcatacgaacggcaggggatcccctgcccgtggcgttactacaacgatcgcgatgtacgcacaatcgttgagctggggaaagccatagacttcgatgccagaactgctaccccattcgaaggtgagcgccataatgcacttgatgacgcccgttatcaggcaaaatacgtttcagctatctggcaaaaactgatcccgagtcaggctgatttttaatgttcaaccgtcgccggttgcaattggtattctgcaaccggcgttcatctgatgtaagagataaagaatcgatgagcgaagtaatcatgatcgtctctcctggcaaatgggtatccgaagagcagttaattgcacttaaaggaatcaaaaagggaacgctaaaaaaagccagggaaaaatcgtttatggaaggaagggaatataagcatgtcgctcatgacggtatgccatgggataacagtccatgcttttacaacctggaagaaattgatcgctggattgagcgccaggcatctgcaagaccaagacgtcatcttgcttgactaaaagcaacacgaaccaatgagagaagctgaaatgaaatatccgacaggcgtggaaaaccatggagggaaattacgtatctggtttgtttataaaggtgtaagagtccgggaaaatcttggggttcctgacacagcaaaaaacagacgcattgcaggtgagctacgcgcctctgtttgttacgcaataaaaactggcgctttcgactatgcaaaacagtttcccgcctcacacaatctggaaaaatttggtgaggcccgacaagatttaaccataaaagaactggctgaaaaatttctggcactgaaagaaactgaagtcgcaaaaacgtcactcaacacgtaccgtgccgtcatcaaaaatattctgagcataataggtgaaaaaaatcttgcatcatcgattaataaagaaaaattgctggcggtacgtaaagagttactgactggataccagatccccaaaagtaactatattgttacacaaccagggagatcggctgttaccgtaaataattacatgacaaatctttacgccgtgttccagtttggtgttgataacggttatctggcagacaatccatttaaggggatctcaccattaaaggagtcgagaaccatcccggatccactttcgcgggaggagtttatccgccttattgacgcgtgcagaaatcagcaagccaaaaatttatggtgtgtttccgtttatactgggattcgccctggtgaactctgtgcgcttggatgggaagatatagatctgaaaaatggaacaatgataatcagaagaaatctggcaaaagaccgttttacagtaccaaaaacacaggcgggaaccaatcgtgtgattcaccttattaagcccgcaatcgacgctctccggagtcagatggcactaacgagactgagcaaagagcatatcatcgatgttcacctcagagaattcggcagaacagagaaacaaaaatgtacctttgtttttcaacctgaagtgtcagcgaaagtaaaaaattatggtgaccattttaccgttgactcaataaggcagatgtgggacgcagcggtaaagcgtgccggaatccgccatcgcaaatcgtatcagtcgagacacacttatgcctgctggtcgttaacagcaggagctaacccggcattcattgcaaaccagatgggccatgcagatgcgcaaatggtgtttcaggtgtacgggaaatggatgtcagaaaataataatgcgcaggtaacgctgttaaatacacagttaagcgagtttgccccaaccatgccccataacgaagcaatgaaaaattaatttaatatttatcaaatagttaacacgcatgactcttgaaatccataaattcaagcgcagtgcccaaccatcccgatactgctgctttcaccaaatccttagtacttctttcgtgtttttctattatcataatggttatctctaaaaaagaggtaagatgcgtactacttactcgccgttattggtattattcagaaaaagtgagtaagactttgcagcaatgtttttgatccagttcaaataaactaatggcatccgcaacatgctggaaatcaaacgtatgggtaattagtttttctggtttaattaaccctttacttaaccagtcgataacgaccgggaatttatttgcatttaagcgtgaagagaaaatagagagttcttttccggtaattccttgctgaatcacttcagacggttcactggagaagcccatcaatacaatacgtgccgctggagaagccagcgttacggcttctttcaggattgaaggatgacaagccgcatcgataattaatgtcggcttgatgcctttttcagcgaaaatctcgccaagcggtgtctggctgttattaatcgcccagtctgccccgctctctttcgctttttccagtcgttcatcaatgcgatcggcaacaatcacattcttaacgttatagacgccttttaatacctgaacgatcgtcaggccgattggacctgcaccgtaaaccagaacggtatcattttcagtcggttgaccatgaccggtaacgttagccgcaatggtaaaaggttcaatcatcaccgcatattgatcggccactgcttcaggaattttccacgcattttttgccggcaccacggcatattcactgaaaccaccgtcagcgtgcacacctaatacagcaagtgtcgtacaaacgttcggcttacctatagagcacggatagcaatgcccacagctgaccaccggatcgacagcaacgcgttcaccgactctggcgctttccacgccgtcacccactgcatcaatgacgccaaagaattcatgaccaatgacgcgcggatatttcgcaaaaggattatgcccacggtaaatatggctatctgaaccacaaattccggcaagtttaacttttactcgtacttcacccgctgacggggtgggtatttcacgttcgataatcgacagttgattcggtttttcaattaaaatgcttttcattaccttactccttaccagttccacagcgtgccatcttccagacgtgcgactggcagataagcaggttcatagggatatttcgccgccagcttttcatcgaattcgatgccaagacccggtttttctcccggatgcatatagccgttatcgaaagtccagttgtgcgggaagacttcgagcatttgttcggaataacccatgtattcctggacaccgaaattggggacccacagatcaaagtgcagcgccgcagccatgcagactggtgacaaatcggaaggaccgtgtgagccagtacgtacctgatacagcgaagcaaaatcggcaatccgacacataccggtaattccgcctgcatgggtcagcgtggtgcggatataatcgatgagttgctcttcaatcagttgtttgcagtcccaaatgctgttgaagacttcacccaccgcgatgggtgtgacggtatgttggcgaatgagacggaagcattcctggttttccgcaggcgtcgggtcttccatccagaacatgcgataatcttcaatgctcttaccaaagcgcgccgcttcaataggcgttaagcgatggtgcatgtcatgcagcagatgttcatcaaaaccaaacttgttacgtaccgcgtcaaacaatttcggcatgaaatcgaggtatttctccgtcgaccacagctgctcttccggccactgtcctttggttgcgggttcataagccagacctttacctttcgacatgccgtaggtggttttcataccagggattccgcactgcacgcggatggctttgaatcccagctcctgatgacgggcataatcatccagagcttcatcaatactgtgaccggtggtatggcaataaaccatcaccccttcacgagacgcgccgccgagtaactggtaaagcggcatgttggcagctttggctttaatatcccacagcgccatatcaaccgctgaaatggccgacatcgtaaccggaccgcgacgccagtaagcacctttatagaaaaactgccagatatcttcgatacggtgtgcatcgcgaccaataagctgcggacaaaggtgatcctgcaaataagaggccacggaaagctcacgtccatttagggtggcatccccaaggcccgtaataccgtcctcagtggtgatttttaatgtgacgaaattacgccccggacaggtaacaaaaacttcagcctttacgatcttcatgttcgattccttgcatcgcttgtcgtgatgcatgaaatctacgcaactgagctactaccatacaagcatgaagatcaaaaaaaagccggagtgatcacaaaaaaaggcgtatatttgcgccgtgaatggttgacaaaagatgaaatagaataccttttgtcagctgacacttcctcgtatcttattgataaaatggatttatgttcctacgtgcgcccccagcccgcaacaatgatcaacatgccgcaaagcgcaattaacgcccccgtccagtcataaagagtcagtttcacgccatccacaacgcgcagccacatcaaagccgtgcagacataaacgccaccataagccgcgtaaacacgcccactcgccgcaggatgcaacgttaacaaccagacaaacagcgccagtgaaatccccgccggaagcaacagccagatactggcgtttcgcttcaaccacagccagggcaaaaagcatccaataatttcacacagcgcagtagcaaaaaatagtaacgttgttttaatcatctttgtcacttattgacatcacgtatagttatagggcgacataatatcatcaatataaacaccctccttgaacgttttgcgttcgcagtggatggtgtagaatcagctttaatcattcatacagggaatgaattatgaaaatcactctcagcaaacgaatcggcctgctcgcttttctgctgccttgcgcactggcattgagcacaactgttcatgccgaaactaacaaactggtgattgagtctggcgacagtgcacaaagccgccagcgcgccgctatggaaaaagagcaatggaatgacacgcgtaatctgcgccagaaagtgaataaacgcactgaaaaagagtgggataaagccgacgctgcttttgataaccgcgataaatgtgagcaaagcgccaacatcaatgcctactgggagccaaatactttgcgctgcctggaccgtcgaactggccgcgttattatcccctaacctgttattgatttaaggaatgtaaggacacgttatgccaagcgcccacagtgttaagctacgcccgctggagcgtgaagatttacgctatgtacatcaactcgacaataacgccagtgtgatgcgttactggtttgaggaaccctacgaagcctttgttgaactctctgatctgtatgataagcatattcacgatcagagcgaacggcgctttgtggtggaatgtgacggcgaaaaagccggtctggtggagctggtggaaattaaccatgttcatcgccgcgcagaatttcagataattatctccccggagtatcaggggaaaggtctggcaacccgtgccgccaaattagcaatggactatggcttcaccgttctcaatctctataagctgtatctgatcgttgataaagagaatgaaaaagcgattcacatttaccgcaagcttggctttacggttgaaggtgaattgatgcatgagttctttattaatggtcaatatcgtaatgccattcgcatgtgtatattccagcatcagtatctggctgagcacaaaacaccgggtcagactctcctgaagccgaccgcacaatagtattaataataatcgatcgtatttttgatggtgtaaacccgttcgacggcgggttttactccttcatcaacaatgattagctgacagtccaccggattggcgtgattgtcatattcacagctctgttttacatttccaacccgttgattattcagtaaagtaaccgctgtgtaatctaattttttgatcgggtccgttgatggcgtggcgctgacagataatgttttatcgttacttttcgtggttttacccagcggatacccctgatcatcatagcgatattccatctgcatctgtttgctgctggctttaatcacgaaaccattatcatcggtttcccaactcaccccggcagaaggtaattctgctagctggcattttccctgcaaacgaactcttttctccagcgtctcggcatcacggtaataattggcgtccagtaccagggcaaccacggtattattttccagatccagtaattcgagagaatcaaaacagccttcttccgacaaagtccccgaaacacgtttcgtcacttcaccttgctcatccattaatgtctgagtgaaatcttttacgggaccacgcagcggatcaaaatcgaattcattagagaaactggccatctccggggtaaatgaaagtgttacctctgtgcggtcacatcctgtgagtaatatcgcgagtaagcatggcagtaatttgtatttcacaacagtcacctgagagtagagatgattctcaatcatagtagcaaatacagtactttacacgttaaatgctatgcttaaagaagttatcttcgcgtaaggagcttatgatgaaactctcaacctgctgtgccgcgcttctgctcgccctcgcctcacccacggcactcgccgcgccgggatcctgtgagcgcatacagagcgatatatcacagcgcattatcaataatggcgtacccgaaaacagcttcacgttaagtattgtacccaatgaccaggttgatcagcctgattcccaggtcgtcgggcattgcgctaatgatacgcataaaattctctacacccgtaccaccagcggtaacgtctctgctcccgcgcagtctacccaggataacgcgcctgctgaaccgcagtaacacattatcgactgaacgccggatacgacacatccggcgatttgaacatacaacataatcccaccttattactcatacccttctattgatatggattaataattattaaccccaaatgggtagactccctctattgttagcgcgctaaatattcaatatataaacatttatataacgataaaaaacagggagtgagttatgtccaaaaataaacaaatggtgggcatcagccgcagaacactcgttaaatctaccgcgataggttctctggcgctggctgcaggcggtttttctttgccgtttaccctgcgcagtgcagcagcagcggtacaacaggccagcgaaaaagtggtctggggtgcctgttccgtcaactgtggtagccgctgtgcacttcgtctgcatgttaaagataatgaagtgacctggggggaaactgacaacaccggcagcgacgagtatggcaaccatcaggtacgcgcctgtttgcgcggtcgctccatccgtcggcgtattaatcatcccgatcgcctgaattacccaatgaaacgcgtgggcaaacgcggcgaaggcaaattcgaacggattagctgggatgaagccctggatactatcgccagtagcctgaaaaaaaccgtcaaacaatatggcaatgaggctgtatatattcagtactcttcggggattgttggcggcaatatgacccgctcttctccatcagcctcggcggtcaaacgcctgatgaactgctacggcggttcactaaatcagtatggctcctacagcactgcgcaaatttcctgtgccatgccctacacctacggcagtaatgatggcaacagcaccacggatattgaaaacagcaagctggtcgtgatgtttggtaacaacccggctgaaacccgcatgagcggcggtggcatcacttatcttcttgaaaaagcgcgcgagaaatcgaacgcaaaaatgattgttatcgatccgcgatataccgatacggctgctggtcgtgaagatgaatggcttcctattcgcccgggcaccgatgccgcgctggttgcgggtattgcctgggtattgattaacgaaaatctcgttgatcaaccttttctcgataaatactgcgtcggctatgacgaaaaaaccttacccgcagatgcacccaaaaatggtcactataaagcctatattcttggtgaaggtgatgataaaacagcgaaaacgccgcagtgggcttcgcaaattacaggtatcccggtagaccgtatcatcaaactggcgcgtgaaattggcacagcaaaacccgcttatatctgccagggctgggggccgcaacgccaggcaaacggcgagctgacggcacgcgctattgctatgttgcctattttgacgggcaatgtcggcatcagcggcggaaatagtggtgcgcgtgaatcgacctacaccattaccatcgaacgcttgccggtgctggataatccggtcaaaacgtcaatctcctgcttcagctggacagatgctatcgatcatggcccgcaaatgacggcaatccgcgacggcgtccggggcaaagataaactagatgtgcccattaagttcatctggaactacgcgggaaataccctggttaatcagcattctgacatcaacaaaacgcatgaaattctgcaggacgaatcgaaatgcgaaatgattgtggtcatcgaaaactttatgacctcatcggcaaaatataccgacattctgctgccagacctgatgaccgttgagcaggaagatattattcctaacgactacgccggtaacatgggatatctcattttcctccagcctgtcaccagcgaaaaattcgaacgcaaaccaatttactggatcctgagtgaagtcgcgaaacgtcttggacctgacgtctatcaaaagttcactgaaggtcgcacgcaggaacattggttacaacatctgtacgccaaaatgcttgccaaagatccggcattaccgtcttacgacgaattaaaaaaatgggtatctataagcgtaaagatcccaatggtcattttgtcgcctacaaagcatttcgtgacgaccccgaggcaaatccacttaaaacgccttccggtaagattgaaatttattccagcaagctggcggaaattgcccgtacctgggaactggaaaaagatgaagtgataagcccactgccggtttatgcctcaacctttgaaggctgggactcccctgaacgtagtgccttcccactgcaactgtttggtttccattacaaatcccgtacgcactcgacctacggcaacattgatgtcctgaaggcagcctgccgtcaggaagtgtggatcaaccctatagatgcacagaaacgtgggattgccaacggcgatatggtgcgggtgtttaaccatcgtggcgaagttcggctaccagccaaagtgacaccacgcattctccctggagttagtgctatgggccagggagcctggcacgaggccaatatgtctggcgataaaatcgaccacggcggctgtgtgaatacgctaaccactctgcgcccttcaccactggcgaagggaaacccgcagcacactaatctggtcgagatcgaaaaaatataacccactacgaccataaattttgacatgacattttgtttgaaaagcaataagtgagtaatgatgaaaatccataacacagaggcgctcatgtcggctgaaatcagtcgtagaagtctgatgaaaacctccgcacttggcagtctcgcgctggcaagcagtgctttcactttgccgttttcccaaatggtccgagcggcacaggcaccggtagaagagaaagcggtctggagttcctgcaccgttaactgcgggagccgctgtctgttacgtttgcatgtgaaagatgacaccgtgtactgggtagagtctgatacgacaggtgacgacgtttacggtaatcatcaggttcgggcatgtttacgcgggcgctctatccgccgacggatgaatcatcctgacaggttgaaatatcccatgaagcgcgtcggcaagcgcggtgaaggtaaatttgaacggataagttgggacgaagccctggataccatcagtgataatcttcggcggatcctaaaagattacggcaatgaggctgtacatgttctctatggaacaggcgtagatggcggaaacatcaccaactcaaacgtcccgtaccgtctgatgaactcttgcggtggttttctcagtcgctatggcagctatagtaccgcacagatcagtgccgcaatgagttatatgttcggtgccaatgatggcaacagcccggatgatatcgccaatacgaaactggtcgttatgttcggaaataacccggcagaaacacggatgagcggcggtggtgtcacttactacgtcgagcaagcccgcgaacgttcaaacgcacgcatgatcgtcatcgatccacgttataacgacacagctgccgggcgtgaagatgaatggctgcccattcgccctggcaccgatggcgcactggcctgtgcgattgcctgggtactgattactgaaaacatggtcgatcagccatttctcgacaaatattgtgttggttacgatgaaaaaacgctgccagctaacgctccacgtaacgcgcattataaagcctatattctgggcgaagggactgacagcatagctaagacgccggaatgggcagcaaaaatcaccagcatcccagcagaaaaaattatccagttggcacgagagatcggttcagcaaaaccggcttatatttgtcagggttgggggccacaacgacattccaacggcgagcaaacgtcccgcgctattgccatgctttccgttctcaccggtaacgtcggcataaacggcggcaactcaggtgtacgcgaaggtagctgggatctgggggtagaatggttcccgatgctcgagaatccagttaaaacgcagatttccgtctttacatggacagatgccatcgaccatggtacggaaatgaccgcgacccgtgatggtgttcgaggaaaagaaaaactggatgtccccatcaagtttttatggtgctacgccagtaacacattgatcaatcaacatggcgacatcaatcacacccatgaggtgcttcaggatgacagcaagtgcgagatgattgttggcattgaccacttcatgactgcctcggctaagtattgcgatatcctgttacccgacctgatgccaacagagcaagaagaccttatctctcatgagtctgccgggaatatgggctatgtgatcctcgcccaacccgcaacctcagcaaaatttgaacgcaaacccatctactggatgctgagcgaagtcgccaaacgcttaggaccagacgtttatcaaacctttactgaaggtcgcagtcagcatgaatggatcaaatatctccatgcgaaaacgaaggaacgtaaccctgagatgcccgactacgaggagatgaaaacgaccgggatctttaagaaaaaatgcccggaagaacactacgtcgctttccgcgcattccgtgaagatccacaggcaaatccgttgaaaacaccttcggggaaaatcgaaatttattctgaacgactggcgaagattgcagatacctgggaattgaaaaaagatgaaattattcatccccttcctgcgtataccccaggttttgatggctgggacgatcccctgcggaaaacctatccactgcaactaacgggcttccactacaaagcgcgtacccactccagctacggcaatattgatgtgttacagcaggcctgcccacaagaggtgtggatcaaccctattgatgctcaggcacgcggtatccgtcatggcgataccgtgcgggtatttaacaataatggagaaatgctgattgccgcaaaagtgactccgcgtattctgcctggcgttaccgccatcgggcaaggtgcgtggcttaaagcggatatgtttggtgaccgggtcgatcacggcggcagtatcaatattctgacctctcaccgcccttcaccgctggcaaagggaaacccgtcgcacagcaatcttgtccagatcgaaaaggtttaaggagtagcccatgaccacacaatatggattttttatcgattccagccgctgtactggctgtaaaacctgcgaactggcgtgcaaagattttaaagatcttggcccggaagtcagtttccgccgtatttatgaatatgctggcggcgactggcaggaagataatggcgtctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcgccacagtacaatgctgaaaaagggcacatgacgaagtgcgatggttgttattcgcgcgtcgccgaggggaaacaacccatatgtgtcgaatcctgcccgctgcgtgcacttgagttcggtccaattgaagagctgcgccagaagcacggcactctggctgccgtcgcgccactgccgcgcgcacatttcacaaaacccaatatcgttatcaaacctaacgccaacagccgcccgaccggcgataccactggttatctggctaatccggaggaagtgtaaaatgggaaatggatggcatgaatggccactggttatctttaccgtattgggtcaatgcgtagtaggcgcgctgattgttagcggaattggctggttcgccgccaaaaatgacgcagaccgtcagcacattattcgtggcatgtttttcctctggctgttgatgggcatcgggtttattgcctctgtcatgcacctgggatcgccactgcgggcgtttaactcgctgaatagaatcggagcttctggtctgagtaacgagattgctgccggttccatattttttgccgttggcggattatggtggctggtggcggtcatcggtaaaatgccgcaagcgttggggaaactctggttacttgtcagcatggcgctcggcatcattttcgtctggatgatgacctgcgtgtatcaaatcgacactgtgccaacctggcataacggttacactacgctggctttcttcctgacggtattgttgagcggtccaatacttgctgccacaattctacgtgcagcccgcgttacatttaataccacaccatttgccatcattagcattctggcgctgatcgcttgtgccgggttgattgtgctgcaaggtttgtctctggcgtttattcactcatccgtacaacaagccagcgcactggtaccagattacgcctccttacaggtctggcgtgtggtattgttatgcgcaggtctaggatgctggctttgtccgctcattcgtcgccgtgaacctcacgttgccggacttgttctggggttaatcctcattcttggcggtgagatgatcgggcgtgtgctcttttatggcctgcacatgacagtaggaatggctattgcaggttaacaaattggtgcggggcaacccgcacatttcaggatgttaggaatgacccatttttcacagcaagataatttttctgttgcggcgcgcgtgttgggcgcgctgttttattacgctccagagagtgcagaagccgcacctctggttgcggtactcacccgtgacggctgggaaactcagtggcctctaccagaagcgtcattagcgccgctggtgacggcttttcagacacagagtgaagagactcacgcccaggcctggcagcgtttgtttgtcggcccgtgggcactgccgtctccgccgtggggatcggtctggctggatcgcgaatctgtgctgtttggcgattcaacattggcacttcgtcagtggatgcgcgagaaaggcattcagttcgaaatgaagcaaaacgaaccggaagatcattttggttcactgctgctgatggctgcgtggttggcggagaatggtcgccagacagaatgcgaagaattgctggcatggcacctttttccgtggtcaacacgttttcttgacgtttttatcgaaaaagcagaacaccctttctaccgtgcactgggtgaactcgctcgcttaacgctggcgcaatggcaatcacaactgttgattcctgtcgcggttaaaccgctgtttcgataggatcaccgtattattgccggatggtgacgattacacgcaattcggcaattaataggttacagtgtcacgttttttatctcttaaagcacgcactgcttttgcggctggcctcttttgccgcaaaatagtcgcccgtgtttcattgcccatttctgctcatgcatcatctacacatctatccggatctgcgcactatgttccgccgtctgcttatcgcaacaatcgtcggtattcttgcggcctttgccgttgccgggtttcgtcatgcgatgctgctactggagtggctgttcctcaataatgactccggcagtctggtcaatgcagcgacaaatctttccccgtggcgacggctgctaaccccggcgctcggcggactggcggcgggtttgttgctgatgggctggcagaaatttacccagcaacgccctcatgcgccgaccgattacatggaagcgttgcaaaccgatggtcagtttgattacgcagcaagcctggttaaatcgcttgcctctctactggtagtaaccagcggcagtgcaattggtcgcgaaggtgcgatgattcttttagctgcccttgcagcctcgtgttttgcccaacgttttacgccacgccaggagtggaaattatggatcgcctgtggagctgcggcgggaatggctgcggcctatcgcgccccgcttgctggcagtttatttatagccgaagtgctgtttggcactatgatgttggcctctctcggcccggtgattatttccgccgtcgtggcgttgctgattagcaatcttattaatcatagcgacgcattactctacagcgtacaactctcagtgacggttcaggctcgtgactatgcgctgattatcagtacaggtgtgctggcaggtctgtgcggaccactgttgttaacgttaatgaacgcctgtcatcgtggatttgtgagtctcaagcttgcgccgccctggcaactggcactgggcgggttgatcgtgggtctgctttccctgttcacacctgcagtgtggggcaacggctatagcaccgtacaatcctttttaaccgctccgccactgttaatgatcattgccgggatcttcctctgtaaactgtgtgccgtgctggcgagtagtggttctggcgcgcccggtggtgtctttacaccgacgctatttatcggtcttgccattggcatgttgtatggtcgtagcctgggattatggttacctgatggcgaagaaattacgcttttactcggattgacagggatggcgacactgttggcggcgaccacgcacgcgccgattatgtcgacgttgatgatatgtgaaatgaccggggagtatcagctactccccggtttattgattgcctgcgtaattgcgtcggtaatttcgcggacgttacaccgtgactctatctaccgccagcacactgcgaagcatagctaagcggatgtattgccccagttcacgctgttcggcgcgcggcagataaggcagttcaccaatgagcggtgccggaagttttttaccgagcacatcaatgatttccgcataatgcgccagtcctgggttgattcggttagccacccagccaatgagcggcagcccgtcgttggcaatcgcctgagctgttagcagtgcatggttaatgcaaccttcctgaataccgacaaccatcaacaccggcagttgttcctgcaccacccattcagagagcggacgcaaatcattcatcagactgcgccagccgccagtcccttctaccacgacatgatcgactttatcggtcaggtttgccaggccgtttgaaatgagggtgtaattgattgggcaactgtgcgccacgctactttcttcttcgcttaacgcgataggattaactgcttcataaggcagttcgatggttgaaacactctgcaacaccagggcatctttattacgcagcccttcgggtgtctctttgctccccttcgctacgggtttatatcccgcaaccgtttttccctgggaggctaacgcttgtagcaatgcgcgggaaaccaccgttttccctacagaagtgtctgtaccggtaataaagaaacgcttcagcatcactaactccaccgttatgcttcacaaatataaaccaggaaaataattaaccttgaaagtctaagttatgctttcctggcccaaattgagatagcgcaaattttggtagaacagttaaaaaatgttaaccctgcaacagacgaatcaacaaagaaccgttatacatcgcgtcttttaccagcgcagcgcctgccatcgtgccctggttagaaaactgagtactctcaacgctaatgtgctgactatacgcaggaagggcctgctgacggatgctgtccgagatgactgggaagaggatatctgccgctttacttaacggtgagccaatcagtattttttgtgggttaaataaattcaccatgatggcaagaatgcgaccgacatgcgcgcctaccccggtaatgatgtcttttgccagtagatcgccgcgcaatgccgcctgacacaatgagtccacggttaacggttgtccatgtaacatcgagctcatggattgattgagacgcagctgtgccagctcaagaatactgtccacactggcgatggtttcgaggcaaccgtgattcccgcaataacagcgtttcccatacgggtcgacctgtgtgtggcctatttccacgaggctactgctgcctgcgtgtagcagatgaccatcggtaatgacgccagcccccacgttgtgatcgataaccacctgaatcacatcgcgcgccccgcgtgaggcaccaaacaaggcctcagccatcgtccatgcgctgatatcatgctgaatataaaccggtacgccggtatgctgctccagcgcctcgccgagcggcatctcttttacatcctcgtagaacggcatgcgatgtacaataccattttccgtatcaataattcccggcaaggttatggcaatcgaagtcagacgctcaagttttttctggtggcggataaaaaactgatcgatatgggaaatgatacgctccagcaatggcgagtcatcttttaacgccagttcctgcgactcttccactaccagtttgctgctcagatcgcgcaaagcaaggaaaatctccccgcgactaatgcgcagagaaagatagtgccaggcttcagtttcaaccaccagccccactgccggacggccacggttccccgcttctttgatttccagctcttgcaccaggtgtgcttcgagcatctcacggacaattttagtgatactggcaggagccagttgcgccagacgggaaagatcgatacgcgagactggaccaagctgatcaatcaggcgataaaccgcgcccgcgttggtctgctttatttgatcaatgtgcccaggctgattttcagcaaccaccgcatactccctatattttcgcgctccgaaataatctgtaggctatggtgaagcacttcaatacgtgtcgtcaaatttttacttaggcatgtgattaacagcacatttttcgggctttttcgctgaaatttccctcacctgagagcattcagcagatgaatacgaaagttacgcgcagccggactttgttcatgatgtttcggccagaccaaccacatttcagaaaccgcatcctcttcagcaatcggcacccagcgcatttcgttgagctgaacacgtttaaatgacgcaggcaaaattgaaacacccagaccggcggaaaccagaccgatgatggtcattgcctcacccacctcctgagtgatgacgggcgtcaaattgtaacgtctcatcagcccgagaatatcgtcatacagccctgttccgacgtgcggatcaaaaaagacaaagggttctttcgccagttcagccagcgttacactcgggttatttgccaggggatgatcgtgcgggatcatcgccataagcggttcatggacgatgactgcgtgttcaagcgtctccggtaactctgtgttacgcagcaatcccatatccagcgttccttcaatgagcggagcgatttgctcgcgagtgttcatttcgcgggtttgtaaatggacatcgggataatcacggcgaaacagcgataacgtatcggacaccgcccgaataaaaggagcggacgaagtaaaaccaatgcgcaactcccccgcttcgccctgatgcagcctttcagcgcgagcggcagcatcatccaccatagacaggatttgccgactatctacaagaaactgttttcctgcttccgtcagcaatacactgcgattggtccgtgccagcagtcgggcaccaatttgttgctccagcgcctgaatctgctgacttagaggtggttgcgaaatattcaggcgggcagcggcacgcccgaaatgcagctcttctgcaacagcgacaaagtaacgcagatgacgaagttcaatattcatatttaaaacatcttatttgagattattaatatattagacagaacaattcgattttcctaatctattcataagcctgatccacaggcatatttagcaaggatttcaagtgagccgtactacaactgttgatggcgctccggcaagcgacactgacaagcaaagcatttctcagccaaatcaatttattaaacgcggtacgccgcaatttatgcgcgtcaccctggcgcttttctctgccggactggcaactttcgcacttctctattgtgtgcaacctatccttccggtgctttcacaagagtttggcttaacgcccgcgaacagtagtatttcactgtccatttcaacggcgatgttggctatcggtttgctgtttactggcccgctatccgatgccattggtcgcaaaccagtgatggtcacggcgctactgttggcctccatttgtacgttactttcgacaatgatgaccagctggcacggcattttgattatgcgcgccttgattgggctttcgttaagtggcgtggcagccgttggcatgacttatcttagcgaggaaatccaccccagtttcgtggccttttcaatggggttgtatatcagcggcaactcaattggcggcatgagcggacgcttaattagcggtgtcttcacggactttttcaactggcgaattgctctggcggcaatcggttgtttcgcgttggcctcggcgttgatgttctggaaaatcctccctgaatcacgccattttcgcccgacttcgctgcgccctaagacgttattcatcaactttcgtctgcactggcgtgaccggggattaccgttattgttcgcagaaggctttttgctgatggggtcgttcgtcacgctgtttaattacatcggctataggttgatgctttccccctggcatgtcagtcaggccgtggttggcttattatcgctggcttatttgaccggtacatggagctcacccaaagccggaaccatgaccacccgctatggacgcggtccggtgatgttgttttcgacgggggttatgctgtttggtttactgatgaccttattcagctcgctgtggctgatctttgccggaatgttactcttctcagccggattcttcgcagcccactccgttgccagcagctggatcggcccccgcgcaaaacgcgctaaaggccaggcctcctcgctgtatctgttcagttactatctggggtcgagtattgccgggacgctgggtggtgttttctggcataactatggctggaacggcgtcggcgcatttattgctctgatgctggtcattgctctgctggtcgggacgcgtttgcatcatcgtctgcacgcctgaaaaaataagtccggactgaggtaaatacccgtccggacttattgcctgctcaaaccaacgttaatagccatcctaaaatagacgaagcgccagccaattcccgcagcgcatctagcgtcatcaggattataagtacccaaataaacggattcattttgctgtgtgtcatttattactgatgcgcagttattctaccgctttgtaagtagtaaaatagttaacacgatcaagactactattattggtagctaaattttccttaagtcacaatacgttattatcaacgctgtaatttattcagcgtttgtacatatcgttacacgctgaaaccaagcactcacggaagtctgccattcccagggatatagttatttcaacggccccgcagtggggttaaatgaaaaaacaaattgagggtatgacaatgaaaaaagtattagctctggttgttgccgctgctatgggtctgtcttctgctgcctttgctgcagagactgcgatcacacctgctccgactgcgacgaccaccaaagcagcgcctgcgaaaaccacacatcataaaaaacagcataaagcagcacctgcccagaaagcgcaggcggctaaaaagcatcataaaaatgccaaagctgaacagaaagcccctgaacaaaaagcgcaggcggcgaagaaacacgccaagaaacacagccatcagcaaccggcaaaacctgctgcacaacccgcagcgtaagttttcaacagtaatgctggcgcgccccctcgcgcctgaaaattacggtgctaagcgggtaacgtttagcaccgcctttagcggagggtagtatggtgggccgttatcgctttgagttcattcttatcatccttattttatgcgcactgattgccgcccgtttttatctttcctgatcgtagttatctgattttactcccactttcatcccgtcccgtctatagtatttatgagggtttgcttttaataatcataattacccaccagagtgtgatatgcgtacaaccattgctgtagtgttgggtgcaattagtttgacgtctgcttttgtgtttgcagataaaccagacgttgccaaatcggcaaacgatgaggtcagcaccctgttttttggtcatgatgatcgtgtgccagtgaatgacacgacccaatcaccgtgggatgcggttggccaactggaaacggccagcggcaatttatgtacggcgacactgattgcacccaatctggcattaacggcaggacactgtttattgacgccgccaaagggtaaagccgataaagcggtagcgctgcgtttcgtgtcaaataaaggtctttggcgctatgagatccacgacatagaaggccgcgttgatccgacactgggaaagcggttaaaagcagatggggatggctggattgtacctcccgcagctgcgccctgggacttcggtttgattgtgctacgtaatcccccttctggcattacaccgttgccgttatttgagggagataaagccgcgcttaccgccgcattaaaagcggctggtcgtaaagtgactcaggcgggctaccctgaagatcatctcgatacgttgtacagtcatcaaaactgtgaagtgactggctgggcgcaaacgtcggtgatgtcgcatcagtgcgataccttgccgggtgacagcggttcgcctctgatgttgcataccgatgacggctggcaattaattggggtgcaaagctcggctcctgccgcgaaagatcgctggcgcgccgataaccgggccatttctgttaccggttttcgcgacaagctggatcaactgtcgcaaaaataatgttcaaacgctgcccgacagcgcgggcagcgtgttcatcaggcaagtttcaccatgatcattccagccaacagcagcaccaggccaatccaacctttacgatttaaccgttgaccaaacaagatccaacctgcggctaacgtggcggcaataccaaacccgccccacaatgcataagcgacagacaagtcgatccctttaacggcctgagaaagcgcactaaaggcagccagcaccgccgccagggaaagcaagccaaatattttgcaacgaaagccgtcagaaaatttcaaaaagacgttagcaacgatttccagcacgattgccaatgccagccaggcggcgtgaacccattcaaactgcgccatggttcacctccagttcaggtttacgcgctttacgggtacctgatttgatcaatacaatcccggcgaccagggtggttaacccggcaattttcatcagcgataaactttcgtcgaataacaaaacgctaaacaaggtaataaataaaataccgataccttcccacagcgcataagccacgcctaaggcgatttttttaacggcgaaagagagaaatatatacgacagagaaatcatcaccagcattaaaataaagccgccatttccctcactgacgctcgcccatttcatggacagcgtaccggtaatttctgtagcaatagccagacctaataaaatccaataaatatacattgtccttctcctgcaagagaattattttaattttcgcttaattcagcgaaaccaaagtaaagtggtcaagccccgcgcttagcgcaagctttggcagaagaaaggactaaagcgcgttgcgccagtgctgctcacctacgagcaagatagtggatgaggtacgaagatgggtaaatgtagaaaataacgtcctgaacaaattgtccataatattacaattatccgcagtgttgcttctcgtcctcgcggatgataattgtcctcggtagttgaacacgcctgatttgtatcatagcttaagaattaactcaaaatattttcacttctttacctgagcggtttgattttcgttatgatgacggagcgaaaaagacattattattagcaaaggaagaaaaaacggggacaagcatggcaaagccgatcatcacgctcaatggcctaaaaatcgtcattatgttgggaatgctggtcattattctctgcggtatccgttttgccgccgagatcatcgtgccgtttattctcgcattatttattgctgttatatataacttatttcacataacacgttgatttaattaaataattttcaccgcaaaaagtgccaaaaatcgcaaaatgactacaccagtgactacaccgttcggtgcactgtatgaaacaacgtggaacaaatagacacaagaaatatacaggcggatcatctttccagggggaagcgcaccaattcatgaggggcgttaatgtcgatatggggatccccacctaccggaatttttttccggttaaacgttaatcaggctggtgggctttacctgttcggtaggtgttatgattatcgtaatacctttcccccaatggggtaaaagcatcaaccgtaacgaaagtcgttatggttgccactgataccccaaatttgggtatcacgagtaagacccaaaatctgggtgttactcttactacccaaactacgggtagtttccgtagtttcatggtcgagttgcagatctgcaactcccccattaaccacaggcgaatttccgccttcggtcattccttaatcatctgcgtaatcataatgattattcagcaagcgcaattttgcactttgcttaaagttcagcgagttaccgcgccgacttcctcaaattgaggtttccgaaaatatcagcgggttagcgattaagctgatcattaattaaactgcgaaaatttcgtagtttgtgactgtctttcaggcagcttgttaacagtcctcagaagcgagggatgtagccacccatttttggtccgtcgggaatatcaaccagttaccgccgcaaccgctccggcttcttccagtggtacgttattttctccttctcccgatacatctccacgcggcgacggtaggccagcaactcaagaactctggttcgtatgttgcgcatatccacgccattaagttctataccatcacggcgcatcacctcagcaacaacacgcgcatagttttcggctgtcacgctgtccggctgcgtggcctgttcgtcagcctgctggctgattccggcaacgcggcggattaatcccgttatttcggcttctgtcatgctgctgacctcattacaccccgctaaattcttccagtttctggcggtggctgtcgcttatatcaaaagcaaaatcctcatgctctgcctggaatgtaccaaacgccatcagcgccgccacgctcgggtctatcttgttcggtgattttttcttgttcggcttgatattggcgttcgcgtcactctgcatcacgacgttactcatcgaccaggacaacaccggatcgccacgatgcacaatcaccctgcggttaacaaaaacttcgaacgatttcgccgccggactgaatctgaggtaggtttgcgggaacggctccacctcaaaacctgccccctgtaattgcgttctgagatgcgtggcgttccacgtatcaaagcccaccagcctgatattaaatttctccgcgtcctgcatgatgtcatctctgatccggtcgtaatcaatgcagtcgccaggcgttgtgcgtatccagcctgctttagcccactgacgatagatggcgcggtttttattggcggggttctgtagctgaaattccggcagatagtgacgggaaaccagcataatggttttaccgaccggaaaggcatagcacacgctggaaatatcgctggttgatgataagtccagccccgcgtaacactcctggccgtgtaaatcttcctccgtgaacgttccggcacactcagcccatgcgccgttacccatccacggggtagccccctggcaccagatattaaatcgctttgtcatcatctccacccactgcgacggaataccccgcgctttctggatggttgaggccagtttttcacgatccacggaaacatcaatattagggttcgcctttatccacatcgccggatcatcaacctcgttttcgtcgtccagttcgtaaatcagtacaaaaattgaatcgttgacctcttcgccgtccaggatctggcagcaataatcatagtgctgcttacaggctgaaacgacgttactgcctgatgtggtaatagcaaataacagcccttcgggacgtgcgcccatccccagctcaagcgcggaataaacgccgttatcggggtgcaagtggtattcgtccacgatggaaaggctggggtttgttccctcgatggttgccgcttttgctgccagcggctttaacaggctgttgcttttcgggtgtatcaccttatgcgcctgaatattcacccgcctgcgtaacggtcgggataaaaggcacatctgacgcgcatcatcaaagacgatccgcgcctggtcacggctcaccgctgcggtgtaaatatcctgctgaccgttctccataatcagaaaccagttagccagaatcgcggcggtcgtggatttcgcatttttgcgcggcacttcgataaaggcgctcgtgtatttgcgccgtccggtggccttaaccttaaagccgaggatgcacgcaaaggcgaactgctgccacggctccagctcaatgggtctgccacgcatcggcccttttacgtgcgggcacaccctggaaaaggcaataaaccgctccacaacctcacgatcgaacgtgtaaagggggctttcaaggtccgaaaagtaccgtttaacggcctgtttcagccgtttacaggccggaattttgcccgtttttacgtcttctgcgtacttattccaggcggtcaagctcgtcctcttcttctgtttccggtggatttttacggcggcttatcgggtcaaaaccgagcaaggaggccatttttatcatcaccctttcagcgtcggattttgcgcttaatgcggggtttctgctctcgccgccctgactgttaacaatgctgaacccgcgcgccgcaaggtctgcaacggctttccggtaaatggagtagttgacacaatacagttccagattgctccagtcggcgggggtcaggtctccccgttccgcaagctgccgcgatttttcccgccactgcttcacggcgatgtcatccaggtaggcgggggctttcggtggtcttgccatacttattttttcgccagattatttttcaaaaaattcccgtgcataaaaatttgaggaggcggtcggtgcccggcggggtcgggtttgtcctgaaaacgcccccaccccgtcatacagcctcatcagcgattgcgaaaacattccataacctcgcggtcacggtcggttaatcgcttcgctgtgatgcgttctgcgcgtcctgacgctttatctttatgccctgtttcctgtgtcttccatgcgtcacgctgccttatcagtccacggataaggcggttttgttcccgctcattaatcagcgtcatacatccagttattgcggttagcggcccgttcttcctcttcacgaaatccacctgcggcacgcttgctttttgttgccggatcaagccatttcgttttctggttatggcacgcctgacacaatggctgatggttccattcgggccagaagagaacatcatcaccgccatcgatggggataatgtgatccaccaccacggcgggcgtatatatccccttctcaaggcatcgcacgcataacgggtttttactcagatacatggcgcggtatttgtcccactgtctggaatatccacgcgcgcggcggtgtcctcgtctggcatcctctgcacgccatgccgcccgcctgtgctcctcacacttgccggatttaacgcgcctgttacagcctggttctgtgcatcgtcttaatggttgccacggcatcagtacacccccacatcacggtaagccgtccagagtgcgcctatcgtcatgggtacgcgtgtttttgcgttatccgcgacaatctggcgattttcatacaggtgagcgataaacatcatgcagccaatctttatggctggcgtgaactccagcccgtcatcaaagcgcctgcctatgtgtatctggcacgcctcaagcgatgcggcaatgtatccgctgattaactggtcttcatcgtcgccatcgatgcggcaatggagtttcacttcttccagggtgataagttcttctgtcatttttccgcgccctcacgacaaagaatttcaaggcgtgtcctggcggcatccggcagcggctgcccgatgatattcagtacacgccccgccagcggccccgtactgacctttatccggctggtggcgttgatgtccttccggtaccgtatccagatccttacggtaccaatcgccagctctgcgcccgatgaaatggcctccttgctgctgaccatgttcacgcttgcccagagtgtgtgaccgtcctcccacgtttcgagtatttcgccggttatatccctggtctgtttcagggtctgaatcgttatcctgtcacgcagtcgccctatgttcattccggtttttctccctcgctgatttttacttcctgtttccatgcctggctgaactcatcaccaccatcacgcggtgacagaccttcacgttcgcgggcttcgttcggacacataacgccggatttgatgccgcgctcataggtggcaaagcgttcgccaggtgtggcccgtaacaggtccgcgctgtcaaactccacctgataccggataccaggtacaggcgaggccaccagcagggcgttttttatctgctgctcaaagttcgccagccacgggcgcatcgtcatggtgagaaatgcgcggcttgcctcgctgaaattgctgtaggtgctgttgctgtattcctgcaaaaaaatcggcgagacgttgaacattcgggcgatgtcttcaatggtgaagcgacgggaggccagccattcagcatcctgattactcatgcccagctgctgatagctcatacccccttcaaggatgggcgtttttccggcatttctggcccctttgtagcgttccagtgcggctaatgcctgtttgcccttcacgccgtccagccattcgcctgacgtgataacccctgccgccatcatgccatcacgcatcacgctcgcgccgtggcgttgttgggccagcccaagccccagcgattcgcggcagatggttacaggtgagcgccccataaaaccgtcatccgtggagtaacgaaggtggagaacctcccacggtaaatagttgcgggtgtttccggtgtaggcgtcagtgatgcagtagcgccagttatgctcacctgtctgctcaacgttcaccgactgcggcgggtaaggatgcaaagcgaccggaaaaccatcacgcccccactgaatcaccgcataagcattaccgtttaacaggcagtggcggatcatcattcgcttaaactggtagggggtctgccatgcgttcgggcgctcgttgaggatgtgatcgaccggatgagaatcaagccactctcgggcctccttccccttctcattgcgtaccaggtacaggtaacacggcatggtagccaccgcctcagagatgaccgtgacggcgttcatgacggcgggcagtgattccgctgtccccgatgatacgtactcacccgcccccgtgttcgatgtgccagccagcgccataaactcatcaagcgtcatgctgcgctgctctttttttcttctgaaaggccacatatcacacccccgctaaatccgcccaccagcggcgattatccgcacgcggcattttttcggggtgctgctcatacagggaacggcgggccagctccacgccggaatcggggtaagccggtaccgatgtaacggtaatttcgtacagttccgccaccagcacggtgcgcacgcatggatctgttgtggtatcccatacatccttacgggagcgaaagccaaagctcatccccgagatgtccccacgcttaaccagttcgataacgtcgcgccctgtactggtatccggtggggtcagttcaaagcgtaaccctgtttcgtcctcttccagtttcagcgtgccggaacgggtgcgccccagtaacatgctgtggtcatgctcatacaggccgcgaacgtcattacccgccgcaagccattcagtaaacgccccccgctggaatttttcgtaaaactcaccccataacagttctgaaagcttatcccagcgaacaacgtagcccgtcagcgtaccggctccgctggtggtgatttccgatgaccggatttccatactcttcataattttttcacccataaaacactaaaggggcttttaagccccttctgtatgctgttaatcgtcgtcctgtggcagttccagaatcttgatcgcgttcgaatccaccacgccaccgcctaaatatttctgcgtgaaaattttgatgaagcccggctctgtgaggttgtccggtctggtgcgaacacctgtttcgtgatcaacaatgtagtaaccgcgtttgaagtcacccagggcaataacgttatcaggcataaactccagatattcgaccggaaggcccagcaacgtatcaggatcacccgcctgtaaacggtcgcgccagatgtaatcaccgttcgcgttcttcaccttctgaagttttgccgccgtcgtggagttaaccacccagaccgcgtttttgcggtattttttacgtaatgcaaatttcaggtcgatcagcgggtccgcagatgtccacgccagagattcggaaggtttaattacctgcaacgtaccaaaatcacgctctttgtcgttcttctctgcacggggtacggataaaaagccttttgcttttttgtcaccgtcgcccacaaccagatcgctttcttcggtttccgtgaaggtgtcgccaatctcgcccgtcagccatgaaaggatgtccacatcggaaaaatccacgatttcctgtgtggtgcgcgggtacgcatagaccggatacagcttaatgctcacctcgttaatctgcggggtgctggtctgttcgcgtgccttaccctcttcaccgtggttaacggtcgcaccgccagcggaaacaagctgcttaaactcgttgctgctgattttcttcacggtacagatgcggcgcatggtggattcatccgccagcattcgcatgatttcggtgttcagttcggggataacggtataaccaccatcagcgggaacgcctgtacttaatgcgcgggtttcacccgtcagaatgtagtttcgtagttctgcggggtcagtggtctgactgcttttacctggcttgctgcgctcttcgtctgcaatggcttcaaggcgggaaatgtctttatcgagggattcagctttagcgcgtaattcgtcaaattttgcgccctcagcatcgttaagactgcggttttctttttcagcgttctccagcatgtcgcgcatctgatttttaatggcggttttctgctggcgcaattcgattattctcggcataaaaaaagtcctggggttaagtaaggaactccaggacgcggcaaacactcaaccgtttttcataaggaaatcagcaatcgcaccgttcgttttcccgcctggtaatgaatattggcgagcacattaacaggcgggaaagtggccccagcgtcctggcaccacgggcgagaataatcatgattcagttcgggtaaaatatgccgatccgctcagtgaacaacgtggaacaaccacgaacaaataatttacaaaaaataacaaaaagccggattgctccggctgtatgtgctgtatgggtgctcagtctctgatccctttcagaaattctatcaatgcatctgtctgttcaggatttactgccagcatttcaccggatagcgcgcaacgaacaaaaccatgatgatccttttcaatcagcgcccccgtttccagaaatgcgcggtaatcagtgatattcatcgtctccatgttgtcagcatggtatttatcacgctgtttaagtatctcatcaaatttcatcggcattgcgttttcctctgttgtgtctgtttgtttcagatagtaactatgccggaccgtgacgaaaagccagtagtgctccataccgtttcaaatgacgcaaaaaaagccggattgctccggctgcgtggtgtggttctggtattcctactctgctaatttgctcagccccatgtctgcgtaagtgcgatttactgcatttctcaggtctgcatagttctccgttggcggctccggtggcctctgtgccttcctggaacattccagccgtcgcatcgtaacctgatgccgttccttgtctgtctccaccagttgcatgacttcaccccatcgtgccgccgccctccggtaaaagccttttgcctcgagttcctccgctatgcggtcatgtaccatcctcaccccctcagaacggaatatcatcaccgtaagggtcatcgcctcccgctggtggctgattaccctgtgtgcctgtggttttgcgtctgttcccgccaggacgtgccgcacgagcactgattacgctgtctgcaataacctgataaccctgccgcgtttccccgttctgtccggtccactggctgacctgcatcgtgccggatacgctggcaacgtcgcctttttgatgtttagccaggaagtcggcctgcttaccaaatgccatcaccgatagccataacgtagcctgcccatcctgcgcctgactacatggcaacgataccgccatacgtgccagcgtcattggtgtgcccttgctggtctgttttacctgcgggtcgtccaccagccgcccgtaagccgctatctgtgctgtcatgctgtctgctctccggttttaacgttgatggttgttacctgttccgcttctgcaatctcccgctctgtcagcgtggcaaagtttgccgccgccgtggtcatgaatgcgcttattagttcgggatgtgctttcgagtatccttctcccgctgtgatgtctatcacctttatagccacctttaaggcgtgctctgtcatctccagcgctttatatcttggtgctgttctgtctttgcgttttttgagtgatttgttaaatcttcctgatgtgtgcatttttatttttaccctcgtgtttaaaaagttttaggttgtggtgcacctcctctacctctctacctaatcatctttcatgtcagtaatggcgcggctttcagatgggtagagggctttcgtggccctctacccatcctctacccgcccctcacaaacgatcttaatcatggtagaagaggtagagaggttttattagccttctacctagccctctacccacttatcatgttgaataatatgcgtttatttcattcaggtagatggggtagagggcttttacaaaaaattataaaaacgcgtcacaatcatcagttgtaattgcgttggtctgcgttactcccttaactctccgcgtaatatattcatgtccgtaaacttttgccgctggcttcatggccttgctgaactcagccacgtttagcggtttgctcctgcctgcgtatgccataaacgccagatagacgcggtaaaggctgtttctggtcgtgtacttcacggaatcgccaccgccacccatcatcaggccgcgcgcttcctccagaaaattcaggaactggcaaaactcaataaccggatccgtctgttgctttatcgccagtgcttcatcaccgtcgcgctgttccagtaataaagcccgtgccttttcagggtcggcaaaattagccagcaagcgacggataattacggggatttcagccgcgaccttctccggcaaatccttgtctttttcgtcctcccttacaatgttgtcgaaccggaaaatcacccgacggcgtgacacacctccggcccgctcggtgaatatcatcgggttattgttggtagccagcaccaccgccctgattaccgccgtgaaacgcttttcatatttcgggttaatttccacggggtcgccgcctgtgattttcttgatgcccgttccttcgcctgtatatttcggctggtcagccaggacgataagacgactcccgacaacctgcgcacgtccaccagcatcatcaagcgatgtcatttcagcgcttaccgtgttctgtttccctgccagaaggctggctatgtgtgtgaatgtacttttaccgctaccgccctctccggtggcctcaataaacatctgccagtcgtaccggttcgccataatcatgtacagcgcggcacatatacgcatcatctttcgcgggtcttttccggctgcgtgctcaagccatttatgaaagtttggcgcgttgtcgcgaatgttctcccctggtgctggtggcgtgtactcaatgccgttgtgcgtggtgatccagttctccggcgtgtgcggggaaaattcccccgctttcaggtcaagcacaccattggcgaacggcagcaaatcgcctgatggctcccccattggttcggcaataacttttaacgcttccacggcgttattgattacgcgcttgctgaaagtggccctgtgctctgaatagatcaccaccatttcgcggctcagctccattgtgctgaccggacaccataccccgccgcgccatacgtgaactatttcactttcaggatgtacgcaaacgccatcaaatcgaccagcaagcagctgggcgcgctcactgtctgccatttgtgccagttgcgtatttttctgctccggcatggtaagccctgcggcaatattttcacgctcagcattcagatagcgccgccagttttcacacttctgggcgtgcattccttcggggtaaaaatttgtgtcctgaatatctgccgccgccagcttctgaccaatctttttggtctccaccaagtccagttctcctgcctggtacagccttacgcgtttttttccatccggaacaattttcagcgcatcaagttcggcaagctgatttggcccaagccacacaggcggaacattatcgccggatgcggggccatcctgctcctgccattgtttcgcgtgcgaccaggcatcactacccgcgaaaataattacctctgtgtctttgtgttttattccgcgtggctgtttttttacgttcggtgccagtttcatttcttacccctgaatacgttaagcatcttttttatttcctgaatattggcgcgtgctttctccctgctggttggtttactgcggggcgctgcctgtaccagagaaaaatcacggtcgaactgataaacaggcataacgcaatcatattcgtagccttcacggcggtaagttacgcgccgttcctccacgccattaatcattaccgtgccgccgtacttatcgcggtaaatatccccgcacatgaatttagtgcgagttttgccgctggcagttaagccaggatatttaagtttcattatttttattccccgatagcgtgacctgataagccgttaatcttctctgatatgctctctattttgctggttgaactatccagtaattcagaaacggctaatattaatcttgcagttgattcatcgcgttcattattcaccagcgactgaagccacatattcattacttcgtttgctgcgttgtttaaagatattgcgctgttggcaaggcttcttaattcactggtcgccagtttattatttttcatagcgtttaaatctctcatcaattaaccacagcgcaacacttcctgacagttttgccagaaggccagctaatgcggatatatcatcatcatttaatttatcagggtacacctcaagaaggcggcaaataatttctgtctggtgcgcacgttcagcggcttcgtgtaatgtaatttccttcattaatgcacctcttttaattcatacactgctgaaataatgacttgtgataagccatattctgatgattcgcttctcaccgcagcaatagccgtctgaacattaacagccttcacattctgagcgataccaattgtgtggcctagtgggttaacagcgctggcaaatacacggaaggttttaagcacggcacaccccctgacgaatacgggcgacaaaaataagatgtgcgtgcggcaactgggcgcgggcttcgcgttcagtggctgcggtaacggtgaatattgcaatgctgtctgtcaggcactgcataaagcgccagacaaagtaagggcgtgcggatacagccatgtgaaaggctcctacagtaattttaaggagtctcgctactacgctgtcaaacatggtggcgagacgtaacagggttgacagactggcactgtagagaccagcgagcgcaaaggctcccccgttacgccccgccataatgcgggtatgggtaggtttacggacacaaaaaaaccgcatatcggaatgtaagcggctgtccgctacagtattcaggctgtcaaacccggtcgccatgtgggcgacgggggaagcatacagccccgtgataattttttgcaagcggtttttacgcatgatgtgacccctgacgaatacgggcggcgaatacagcaacacaaccggacgggcaacggctacgcgcttcgcgttccgtccaggcggttacgtggatgatttgagattctccggcactcagtgccagaaaacgccacacaaaggccgtttgtgtgtgtacaaggtgtggtatatgatttacggcaaccataacggctcctcgtttacgttgttggttagaagccctgcgagtggtaacgacacttgcggggcttcgtcgtttcaattgctgaattgcatgtatcagcacttgtggtattcacattacatttaggtgaataccatttcaagtcttttttggtattcacttttgtattacactgcatcccgttattaatgggaggtgcaaacatgtccaggagttctgttaacaataagtcacagcaactgaatgccagatttccacatgaagtagtgagtggcattgaggcatccctacagccaggggaaactaaagcgaattttatagttacggctgtacgcggtgagatcgccaggcgccaggcagaaggaagtggagaaaatccccttgtgtcttcactggatgccctagctaatgtcgaacaaatcggcatcaaggcagcggaggaaatcgggcagcttatcaccgttgcacgcgaagaactccagcgccgcaaggccaaagaatcagaataatcactatcagcgccgtggcgtgaggtactacggcgcattgctttacagggcagtatcatgaccaacaacacactatcaccaatacaagacacgcaaacgcaagatgatgaaatcatccggcaaaggcagtcagaagcctgcgccagacttgaggaagaactaaccagaacaaaaataccaccaccagcgccgcgcttagtgccaccagaaaaatttgcccttgaagattttgtcgataaatacccacggcggcttaaatccggcaaaaaccgaccgccaggatgagtgcacaaaaccgaactatgaaacggattattccgtttccggggcgtttgtgtgtgtataaagagtaagctatgctcttttatagccataatcgttacctcaattaatggtttggttagacgccccgtatgtgttcccagcactgcggggcgttgatttttgtgtaatggcaagtacaatggtaattaccatgtaggtatagtaatgaagggtaattaccatgtcaacaccattagaaaaacgttcgcctccataccaaatgcgattaccggaagacttcagagcgcagctagaagaagcagctaaggccgatggcgacacatctttagccacttggattaaacgcgttctccgcaaagaattacagcaacgcggcatagaacccaaaggataaaaactatcagcgccgtggtgtgaggtattacggcgcattgctatgcaggacaacacaatgaccgataaagaattgaccaaaacattatcaccggcacggaaaagacggcgcagaaagatagagcatgaatcagaaagattcgcgccatgtgcttttgcccttgagcaattccttaaagagtacagggaaacgcgcccattgcaggtatggcaacgaactgaaccagactgatagcattgcccaccagcctgatagcggctatcatccccgtgcttatgtttgggatcatatacacataaggcgcagcgggttatctgttcagaaaggcggctccatttcggggccgctttttttatgcctgaaaaaccccaattttgtggttttccagtctcaccagggcgaacgaatccccgcccacgttctggcgtatattcaatcttcatggttatagctctgtgttcagatgattgatgtgtggcggctgtgtgccgccagcgtgattaatgaactgccttgcagctatccttccaggccagaacctcggataaagaccagccaacggaacgaccgccaagtttacgacgtgatgggaattgtccggccttttccaggcggtagcggcatgagcggctaaggcctgttagcttttcgcattctttttcacgtataaaccgatcagtgcttaacactattgccccctttcgtttcttaaagagttatttcgtgttctattgcgttgggatgtgtctgattgtgtcaggatgattcagagttggcaaatgttgaggccgtatggtttacagaaagaggaataatcaggataaaatcatttaaattcatgttaatacaaaggcataaaatattgtttcatgccttttttctcgctatttaaagagtgattcgctagtgtataaaaaaccagtaacacattaaaaatcagctacttataaatctgtacactttttcgcctcttgttcgtagttgttccgcattgttgctcattgttgcacgttgtatctgttcgcatatccagtatgcgcatactgaaaaaatacgaaaaaaattattttcttctggctactggtagcgtggttacgttttcatgtgttcccgccagtatccctaaccgctccatccacatatccagcacattgcgtttagcatccagataacgggaatgattataaactcgctgcattcctggcatctggtggcctgtaagctgctccacgacatgcggatcaacgcctaaatcgttcagcatggttgtaaaggtgcgccggatgtcatgcagtgaccagtgaggatgattaagcctcctgtgcgctaatcttccatactgcgatacgctggcctcctgtttcgcttcccccagcaataagcccgtgtgcctgttctgctccaccagctgcgtgacgaacggcaggatcgcttccggtatgggccggaatattgcgaccttcgttttgctgtgctccttcggaacggtccatagcatttccgtaaaatcccactccccgatctccgatagcctcagttctaccgtcctggctccgaagacaatcaggaggcggattaacgcgacgtagtaaggggaaaatatttttttgtccagtgcctgcaataattcgccaagttctttgttacttaagacacgttcgcttatatccggttttttcccaacgtccgccacgttcagatcgtccagaacgttgctgattgcatagcgccgcctacggcagaacttaagcgcctgtttgcacgcctgtagcacgaatccggcagtaacaggcgttcgctttgccacctggtcaaaacaggccagccagtgccgtagctcgcatttatccagcggcatagcaccaatctgctgtattacgtgattattaagtcgccttttcagggcgatataatccacgcggttttcctttacgtaagactcaagccagtaggtgagcgcatcgccaaccgttacgggctttaacgcttcctgtacggtgtaattcatctcatgacgtggatttttcccctcagccagccatgtgcgacactgtgcggctttttccctggctgctttcaggctcagatcaggataacttcccagcttaatgcgttcgggtcgtgtctcccttcccgttccggccctgtatgtgaaataccaggtcaatttccctgatgttaaatatttcacgctcaggtttccgccatcactataaaacgtgtttttctccgctggcttaccatgaagtttccttagcaaggtatcgctcagtttgttcattgctctgctcacgttttaccccctctttacgaaaaagtgactacaccagtgactacaccgatcgttgcacaaagggctacaacgtgaaacaagctggaacaaggaaaatcacaaatctgttgataatcaaaaacataatgcacagcctgaaacattatgaaacagcaaaaaacactaaatgataaaatgctgttattcttaacccgctggtgcaacacatggtccgctggcgtgtgccgcgtgtactggcagtgtcaattttgatgaccatcatcgtgatggcgatggtgttgctgttagcttatctgggttccgcgctcaatgagttgacgcggacgttaccgcaatatcgcaactctattatgacgccgctgcaagcgattgaaccgttgttgcaacgcgtagggattgatgtctcagttgaccagctggcgcattacattgatccgaacgcggcgatgacgttgctcaccaacttattgacgcagttatctaatgccatgtcatcaatctttttattgctgctgacggtgctgtttatgttgctcgaagtgccacaattgcccggaaaatttcagcaaatgatggcgcgtccggttgaagggatggcggcgattcagcgtgcgattgacagtgtgtctcattatctggtgctgaaaacagccatcagcatcatcaccggccaggtcgcctgggcgatgctcgccgcactcgatgttcgcttcgcttttgtctggggattgctggcctttgcgcttaattacatcccgaatattggttcagttctcgcggcaatcccccctatcgctcaggtactggtgtttaatggcttctacgaagcgttgctggtgctggcgggatatctgctgattaatctggtcttcggcaatattctggagccgcgcatcatgggacgtgggctggggctttccacattggtggtatttttgtcgttgattttttggggatggttgttaggaccggtgggtatgctgctttccgtgccgttgacaattattgtcaaaattgcgcttgaacaaacagcgggaggtcaaagcatcgccgttctgttaagcgatctcaataaagagtgacggcctccgcagaggccgtcagggttacagagctttcaggattgcatccacgctggctttggcgtcaccaaacagcatgtgggtgttttccttgaagaacagcgggttttgcacaccagcatagccagtgttcatcgaacgtttaaagacaatcacgttctgcgctttccacacttccagcacaggcataccagcaatcggactcttcggatcatcctgcgccgccgggttaaccgtatcgttagcaccaatcaccagtacggtatcggtatcagcaaagtcatcgttgatctcgtccatttccagcacgatgtcatacggtacttttgcttcagccagcaatacgttcatatgtccaggcaaacgccccgcaaccgggtggataccgaaacgcacgttgataccacgagcgcgcagtttctcggtaatttcagcgacaggatattgcgcctgcgcgactgccatgccgtaccccggagtaatgatcactgaatgggagtttttcagcagttccgctgtctcttctgcggtgatttcgcggtgctcgcccacttcctgatcatcaccagtagaagagccgtcagtgccgaaaccacccgcaataacgctgataaaggaacggttcatcgccttacacataatgtaagaaaggatagcgcccgaagaaccgaccagcgcaccggtcacaatcagcaggtcgttgctgagcataaagcccgcagccgcagccgcccagccggagtacgagttcagcatcgacaccaccactggcatatctgcaccaccgatggaggcgactaaatgccagccgaataccagcgcaatggcggtcattatcagcaatgccagcacttgcaggccgacgctatccgtgcgaacaaatacaatcagcagcaggaaggaaacgatcagagccgccaggttcattttgtgacggtttggcagcatcaacggtttagacgaaatcttgccacacagtttgccgaacgccaccaccgaacccgtaaacgttaccgccccgatgaagataccgaggaacacttccgtcaggtgaatattgaccagaatcggtgccattcccgcgtcatgatgcagatagctgttaaaaccaaccagcactgccgccagacccacgaagctatgcaggatcgccaccagttctggcatttcggtcatttcaactttcttcgccagccggataccaattgccccaccaatgaccatagccagcaagatccagccaacattacccgtatccggtccaaaaatggttgcgattaacgcaatcgccatcccggcgataccgaagttgttaccctggcgagacgtttcatgtttcgaaagaccggccagactgaagataaacaggatcgcggcaacaatgtatgcagctgtaactaatcctccagacatatgttaccccttaatttttgcggaacattttcagcatgcgctgagtcacggtgaagccaccgaaaatattaatgctggctataagcaccgcgataaaactaaggaagctaacccagccgccctggccaatctgcaacagtgctccgacaacaataatccctgaaatcgcgttggtgaccgacatcaacggtgtatgcagcgcgtgcgatacattccacaccacgtaataaccgacaacgcaggccagcgcgaacacagtgaagtgtccaaggaactcttttggcgcaacgcttgccatccagccgaaaaggatgattgccaacgccatcaacgcgtatttacgccacggtgagcaggcacatttttcctcagttttcacttccggtgccgctttttgtgccgcctgcggctgagctgatacctgaatcggcggtgccggccaggtaatttcgcccgcacggatcacggtcacgccgcgaatcaccacatcatcaaaatcaacagtgatgttgccgtctttctctttgcacaacagtttcagcagattaacgaggttagtgccgtaaagctgtgaggattgcgtcggcagacggcccggaagatcggtgtaaccaattactttgacaccattttccgtagtgaagatttcacccggcacggtgtattcacagttgccgccgttttgggctgccaggtcgacaatcacactgcccgccttcatggagtcaaccatttcacgggtaattagcttcggcgctggtttgcctggaataagcgcggtggtgacaatgatatcgacctcttttgcctgggcggcaaagagttccatttccgctttgatgaacgcgtccgacatcactttggcatagccatcaccgctgcccgcttcctctttaaaatccagctcgaggaattctgcgcccatactttgaacttgttctttcacttccgggcgggtgtcgaatgcacgcacaatcgcgccgagactgtttgctgcgccaatggcggccagacctgcgacaccggcaccaatcaccatcacttttgccggtggcactttcccggccgcagtgatttgtccggtaaagaagcgcccaaattcatgtgccgcttcaacaatggcgcgataaccggcgatattcgccatcgagcttagtgcgtccagcgattgtgcgcgtgagatacgcggcacagagtccatcgccatcacggtcacgttacgttccgcaagtttttgcattaattccggattctgcgcaggccagataaaactcaccaacgttgtcccaggattcagtaacgcaatttcatcatctaacggcgcattgaccttcagaatgatctctgactgccagacgctattcccttctacaatttcagcgcccgcttgcacaaacgctttatcgtcaaaacttgccagttgacccgcgccgctctctaccgcgacggtaaaacccagtttcagcagctgttccactgtttttggcgttgctgcaacacgggtttcattggttaaccgttctcttggtatgccaattcgcatgatattcccttccatcggttttattgatgatggtttgcctgtgtcaggagccacacaagccgctcatgtacgagctaaatgttactccgttaaaataaattagtaacaaacgccctataacgtactgaaaattatgcctgtgatctagcgccaaaaatcagtatttcggcgtgaactcgcaaaatattaacgattcagccgtgatagtgggataaacaccttagaacgccggataaagactgataattgtcttcggcggccgggtaaaacgagacatcgccccggcacaaatcactacttaacattaaattaacttatacaattcagttgcttcagtagtattgatggtgatacggctgttttttaagcatagacggtcatttgagcagaattaaaattggtttaaggaatgtgatatgaaaaatgacgcagacagttacaccgtttaaatgcaataatcagccacgtttctcgttaataacaataccagtacctggtttgcgcaaggcgaaggattatttttatgaagcttaagaacaccctcctggcgtcggcactgctttctgctacggcattctccgttaacgcagcaacagaactgacaccggagcaagcggcagcggttaaaccttttgaccgtgtagtggttaccggtcgttttaatgctattggcgaagcggtgaaagccgtttctcgtcgcgcagataaagaaggtgccgcctctttttatgttgtcgacacttctgattttggtaacagcggtaactggcgtgtagtcgctgacctctataaagccgatgctgaaaaagcagaagaaacaagtaatcgcgtaattaacggtgttgtcgaactgccgaaagatcaggctgttctgattgaaccgtttgacacggtcaccgtccagggcttctatcgtagccagccagaagtcaatgatgccatcaccaaagcggcaaaagcgaaaggtgcctactctttctacattgttcgtcaaatcgatgccaaccagggtggtaaccagcgtattactgcattcatctataaaaaagatgctaagaaacgtatcgtccagagcccggatgtaatcccggcagattccgaagcaggacgtgcagctctggctgccggtggcgaagccgcgaagaaagttgagatcccgggggttgcgactaccgcatcaccaagttctgaagtcggtcgcttctttgaaacccagtcatcaaaaggcgggcgttacaccgtcacgctcccggatggcactaaagtcgaagaactgaacaaagcgacagcagcgatgatggtcccgttcgacagcatcaaattctctggcaactacggcaacatgaccgaagtctcctatcaggttgcgaaacgtgccgcgaagaaaggtgctaagtattaccacatcacccgccagtggcaggaacgtggtaataacctgaccgtcagcgcagatctgtataaataactattcagttactcctataaggcggcttgatgccgcctttcgcatttttagtcataaatttccctgcgaccattgcatgcagacacatctcttcgtaaaatcccgcgcttcagtggcaaactccatttttatgcgttttgccctaatatttattcttcttgtcacgttttaatcactggatatcgatggaaaagaaactgggactgagcgcactcaccgcgctggtattaagctcaatgctgggcgcgggtgttttcagtctgccgcaaaatatggcggcagttgccagcccggcagcactgctcatcggctggggtattactggcgctggcattttattgctggcctttgccatgctgatcctcacgcgcattcgccccgaacttgacggcggtatctttacctatgcccgcgaagggtttggcgagctaatcggcttttgttccgcatggggatactggctgtgcgcggtcatcgccaacgtctcctatctggtgatcgttttttccgcgttaagcttttttacggacacgccggaattgcgcctgtttggcgatggtaatacctggcaatcgatcgtcggtgcatcggctttattgtggattgttcactttttgatcctgcgcggggtgcaaaccgctgccagcattaaccttgtggcgacactggcaaaattgttgccgttgggtctgtttgttgtgctggcgatgatgatgttcaaactggataccttcaagctcgacttcaccggacttgcacttggcgtacccgtgtgggaacaggtgaaaaacaccatgctgatcaccctgtgggttttcattggtgtggaaggtgccgtggttgtttctgcgcgtgcgcgtaataagcgtgatgttggcaaagcgacactgctggcggttctctccgctctgggcgtttatttgctggtaacgctgctttcgctgggcgtggtggcacgtcctgaactggctgaaattcgtaacccgtcaatggccggtctgatggtggaaatgatgggaccgtggggcgaaatcatcatcgctgccggtttgatcgtttccgtttgcggcgcgtacttaagctggaccatcatggcagcagaagttccgttccttgcagccactcataaagcattcccgcgcatttttgcgcgccagaacgtacaagctgcgccatccgcttcactgtggctgaccaacatctgcgtgcaaatttgtctggtgctcatctggctgaccggttccgattacaacacattgctgaccatcgcctcagaaatgattctggtgccctatttcctggtcggcgcgttcttgctgaaaatcgcaacccgtccactgcataaggcggtaggtgtcggtgcctgcatttatggcttatggttactgtacgcctctggtccaatgcacttgctgttatccgttgttctgtatgcgccggggctgctggttttcctgtacgcgcgtaaaacgcatacacatgataatgtactgaaccgtcaggaaatggtgctgattggcatgctgttaattgcctcagttccggcgacctggatgctggtgggataacgttcatcccatcgttggatagcaaaggagataacgatgggtaaaacccagtccttgccaatattaattactggcggaggtcgccgcatcggcctcgccctcgcatggcatttcattaatcaaaagcaaccggtgattgtcagctatcggacgcactatcccgccattgatggactgattaaggcaggtgcgcagtgtattcaggctgatttttcgaccaacgacggtgtgatggcgtttgccgatgaagtactaaaaagcacccatggtctgcgtgctattttgcataacgccagcgcgtggatggcggaaaaaccgggagcgccactgaccgacgtactggcttgcatgatgcagatccacgttaataccccatacctgctcaaccatgctctggaaagattactgcgtgggcacggacacgccgccagcgatatcattcactttaccgattatgtggtggagcgcggtagcgacaaacatattgcgtatgctgcaagcaaagcggcactggataatatgacccgctcgtttgcccgcaagctggcaccggaagtgaaagtgaattctattgcgccatcgctgatcctgtttaatgaacatgatgatgctgaatatcgacaacaggcgctgaataaatcactgatgaaaacagcgcctggcgagaaagaagtgatcgacctggtcgattacttacttaccagctgctttgtcaccggacgcagtctcccacttgatggcggtcgtcatctgcgttaatgcagcttaatccagcatataatcaacacccatgcgcttattccccagcacgcaacagagctaacaaaagcagcgggcaagcgcatcattccggtgaaataccatagggacgccaggtaaacaaaatagggaataatcgaccacatactaaaaatgatggttgcgcgtaaggcttcaatgccgcgttcgctggcaacaatataatgcgcgataagcgcaaaggtcgggaaaagtggaatcagcccggcgatataataatttttcgtttttgctaaaacaccaatcaacagcactaccagcgcaccgagcgcagctttgattaccagccccatctttttaccttaacactttcataacaagtcatcagtagaatacctgatgaaaccttgtttagaaacgattgatagtaagtaaaaacagtgcggtgtattgtgacgtttttatatctaccgtgaatgttatgaacactatcgtatttgtggaagatgatgcggaagtcggtgcactgattgccgcatacctggcaaaacatgatatgcaggttaccgtagagccgcgcggcgaccgggccgaagaaactattctgcgagaaaatccggatttggtgttactcgacatcatgctaccaggcaaggacggcatgaccatttgtcgtgatttacgcgcaaagtggtccggaccgattgttcttctaacctctctcgatagcgatatgaaccacatcctggcactggaaatgggtgcctgcgactatattctcaaaacgacgccccctgctgttttgctagcgcgtttacgtttgcatttgcgtcagaatgagcaagccacagtgaccaaaggtattcaggaaacgtctctgactccctacaaagccctgcatttcggcacgttgaccatcgatcccatcaaccgcgtagtcaccctggctaacactgaaatctcgctctcgacagctgatttcgaattattgtgggaattagctacccatgccgggcaaatcatggaccgcgatgcattgctgaaaaatttacgcggcgtcagttatgacggactggatcgtagcgtggacgtggctatttcgcggttaagaaaaaaactgctcgataacgccgcagaaccttatcgtattaaaaccgtgcgtaacaaaggctatctttttgcgcctcatgcgtgggaataagcgatgaaaaaactgtttatccagttttacctgttattgtttgtctgcttccttgtgatgtctctgctggtcgggctggtgtacaaatttaccgccgaacgcgcaggcaaacagtcgctggatgatttgatgaacagttcgctgtatctgatgcgcagcgaattgcgtgagatccccccacacgactggggtaagacgctgaaagagatggatttaaatctctctttcgatctgcgtgtcgagccactgagtaaataccatcttgatgatatttccatgcaccggctgcgtggcggcgaaattgtcgctctggacgatcagtacacttttttgcaacgtatcccgcgcagccactacgtgctggcagttggtcctgttccttatctttattacctccatcagatgcgattgctggatatcgccctgatcgcttttattgccatttccctcgcctttccggtgtttatctggatgcgtccgcactggcaggatatgttaaaactggaagcagcggcgcaacgatttggcgatgggcatctcagtgagcgtatccactttgatgaaggttcgagctttgaacgacttggcgtcgcatttaaccagatggcggacaatatcaacgccttgattgccagcaaaaaacagcttattgacggtatcgctcacgaactgcgaacaccgttagtgcgcctgcgttatcgactggagatgagcgataacctgagcgccgccgaatcccaggcgttgaatcgcgatatcagtcaacttgaagctttaatcgaagagctgctgacttatgcccgactcgaccgcccacaaaatgagcttcatcttagcgaaccagacctgccgttgtggctgtcaacgcatctggcagatattcaggcagtaacgcccgataaaacggtacggataaaaacgctcgcgcaaggccattatgcggcgttggatatgcgcttaatggagcgcgtgctggataatttgctcaataacgccctgcgctactgtcactcaacggttgaaaccagcctgctactgtcggggaatagagcgacattaattgttgaggatgatggcccagggattgccccagaaaaccgcgaacatatctttgaaccttttgttcgcctcgatcccagccgggatcgctcaaccggcggctgcgggctggggctggcaattgtccactctatagcactggcaatgggcggtacggttaattgtgacaccagcgaactgggtggtgcccgcttctcgttcagctggccgttatggcataacatcccgcaatttacctctgcctgacactatgcgcacggtggtcaagtcaccaccactgtgctataaaataaggatgttgtaactaaagtggttaatattatggcgcgttacgatctcgtagaccgactcaacactacttttcgccagatggaacaagagctggctgcatttgccgctgagctagaacagcacaaattgctggttgcccgcgtgttctctttgccggaggtaaaaaaagaggatgagcataatccgcttaatcgtattgaggtaaaacaacatctcggcaacgacgcgcaatcgctggcgttgcgtcattttcgccatttatttattcaacaacagtccgaaaatcgcagcagcaaggccgctgtccgtctgcctggcgtgttgtgttaccaggtcgataacttttcgcaagcagcgttagtcagtcatattcagcacatcaataaactcaagaccacgttcgagcatatcgtcacggttgaatcagaactcccctccgcggcacgttttgaatgggtgcatcgtcatttgccggggctgattacacttaatgcttaccgcacgctcaccgttctgcacgcccccgccactttacgttttggctgggctaataaacatatcattaaaaatttgcatcgtgatgaagtcttggcacagctggaaaaaagcctgaaatcaccacgcagtgtcgcaccgtggacgcgcgaggagtggcaaagaaaactggagcgagaatatcaggatatcgctgccctgccacagaacgcgaagttaaaaatcaaacgtccggtgaaggtgcagccgattgcccgcgtctggtacaaaggagatcaaaaacaagtacaacacgcctgccctacgccgctgattgcactgattaatcgggataatggcgcgggcgtgccagacgttggtgagttgttaaattacgatgccgacaatgtgcagcaccgttataaaccacaggcgcagccgcttcgtttaatcattccacggctgcacctgtatgttgcagattaacccccggctttcatactgccgaccatctgttctggccgtacccagcggtcaaactcggcttcgctaagataccccagcgcaagggccgccgcttttaaggtcagcccttctttatgcgcttttttggcgatctcggcggctttgtcataaccaatgtgggtgttaagcgcagtcaccagcatcagcgattcattgagtaattgattgattcgctcacgattcggttcaatgcccactgcacagtgtttgttgaaactttccatgccatctgccagcaagcgcaccgattgcaggaaattatggatcaccatcggacggaagacgttcagttcaaagttaccggaagcgccacccatgttgatcgccacgtcgttccccatcacctgacagcagagcatggttaatgcttcgcactgtgttgggttcactttccctggcatgattgagctgcccggctcattttccgggattgagatttcaccaattccgcagcgcgggccagaggccagccagcggacatcattggcaattttcatcagtgacgcagccaaccctttcaacgcgccgtgcgcctgaaccagggcatcacaggtcgccagcgcttcaaatttgttcggcgcggtaacaaacggtgcacaggtaatgactgccagttcatctgctacgcgacgcgcatattccggatgggtatttagtccagtacccaccgctgtaccgcccagagccagttccgctacgtgaggcaggctgtattcgatatgtttgagattatgctccagcatcgctacccagccggaaatctcctgccccagcgttaacggcgtcgcgtcctgcaagtgggtacgaccgattttgacgatatcggcaaatgcgcgggatttttcactcagcgtctgggtcagggttttaagttgtggaatgagttgcttgcgcagcgccagtagtgccgcaacgtgcatcgccgtcggaaagacatcgttggaactttggcttttgttcacgtcgtcgttagggtgaactttacgttccatcccgcgcacgccgccgagtaattcactggcccggttagccaacacttcgttcatgttcatgttactttgcgtgccggagccggtctgccagatagccagcgggaattcgtcgtcatgctgtcctgccagtacttcatccgccgcctgccgaatggcgctcgctttctcttcagacaacaagcctaaatcttcattaacttttgccgctgcgcgcttggttagcgccagcgcatgaatcagtgaggtgggcattttctccgtcgaaatgcggaaatgctccagcgagcgctgagtttgtgcgccccacagcttatctgccgggacatcaatcgctcccatcgaatctttttcgctgcgtactgtattcatggcctgctcctcacctgattaattttttctttctgttttgctttcgttaagcaacttttagctcactcattatttaccatttgataacaaacgtttggtctttcgtgccatgtaaaaaaaccgccccgaagggcggctctgtttatttcacacagcgggtgcattgtgtgagttgtatctgctggaagaagtcatttcctttatcatccacaaggataaacgccgggaaatcttccacttcaattttccagatggcttccattcccagttccggatattcaacacattccaggctcttaatacttccctgcgctaatacagctgccggaccaccgatactgccgaggtagaagccgccgtgttttttacaagcatccgtcacctgctggctgcggttgcctttcgccagcatgatcatacttccgcccagcgcttgcagttgatcgacataagaatccatccgtccggcggtcgttgggccaagagaaccggaggcataaccttccggcgttttggccggacccgcgtagtaaatcggatgatctttaatatactgcggcagcccttcaccgttatccatccgctctttcagtttggcgtgagcaatatcacgaccaacgataatcgtgccgttaagcgataagcgtgtagaaacgggatactgcgacaactgtgcgaggatctctttcatcggacggttaaggtcaacgcgcaccgcttcgccttctcctgctttgcgcagctcttccgggatatatttgcctggattatgttccagtttttcgatccaaatcccctgacggttgatcttcgctttgatattacggtcagcagaacaggagacgcccataccgaccgggcaggatgcgccgtgacgtggcaggcgaatcacgcggatgtcgtgagcgaagtatttaccaccaaactgcgcacccagaccaagattttgcgcttcgatcagcaattctttttcaagttccacatcgcggaacgcctgaccgtgctcattcccttccgttggcagttcatcatagtatttagcggaagccagtttcaccgttttaagattcgtttctgcagaagttccaccaataacgaacgcaatatgatacggaggacaggccgccgtacccagcgtgcgcatcttctcaaccaggtaatttttcagttttcccggcgtcagtaacgctttggtttcctgatagagatacgtcttgtttgccgaaccgccacctttggcgatacagaggaatttgtactcgtcgccatcaacggcataaagatcgatctgcgctggcaagttggtgccggtattcacctctttatacatatccagcggcgcgttttgcgagtagcgcagattatcctcgatataagtgttatagacaccgcgcgccagcgccgcttcatcaccgccaccggtccatacacgctgcccttttttaccaacaataatcgcggtgccggtatcctgacaggttggcagaacgccttttgccgcgatgtcggagttacgcaggaattgcagcgccacatatttatcattttcgctggcctccgggtcacgcagaatgtcggccacctgttgttggtgagccggacgcagcataaatgacgcatcatgaaacgcctgacgcgccaacagagttaacgcttcgggtgcgactttcaaaatctcctgcccttcaaattcagatacgctaacgtgttcgctggttagcaggtaatactcagtatcatcttttttgagtggaaaaggagcctgataatgaaagggtttgtttgacattgttctctcacttactgcctggtttggttatgctctgggcgggtgttccgttgccctgttaaaagcgagtaacaatatcctacacacttttttaacaaaaactgagactagtacgactttttgcggctccaggttacttcccgtaggattcttgctttaatagcgggattaatttccacattaaaacagggattgatcatgcaaaaactcattaactcagagcaaaactatgcctggggcagcaaaacggcgttgactgaactttatggtatggaaaatccgtccagccagccgatggccgagttgtggatgggcgcgcatccaaagagcagttcacgtgtgcacgatgccacaggagatatcgtttcactgcgtgatgtgattgagagtgataaagcgactcttttgggagatgccgttgccaaacgctttggcgagttgcctttcctgttcaaagtattatgcgcagcccagccgctctccattcaggttcatccaaacaaacgcaattctgaaatcggttttgccaaagaaaatgctgcaggtattccgatggatgccgctgagcgtaactataaagatcctaatcacaagcctgagctggttttcgccctgacccctttcctcgcgatgaacgcgtttcgtgagttttccgagattgtctccctgctccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgacagccagcagggtgaaccatggcaaacgattcgtttaatttctgaattttacccggaagacagcggtctgttctccccgctgttgctgaatgtggtgaaattgaatcctggcgaagcgatgttcctgttcgctgaaacaccgcacgcttacctgcaaggcgtggcgctggaagtgatggcgaactccgataacgtgctgcgtgcaggtctgacgcctaaatacattgatattccggaactggttgccaacgtgaagttcgaagccaaaccggctaaccagttgttgacccagccggtgaaacaaggtgcagaactggacttcccgattcctgtggatgattttgccttctcgttgcatgaccttagtgataaagaaaccaccatcagccagcagagtgccgccattttgttctgcgtcgaaggcgatgcaacgctgtgtaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagcttattaaaggcttataacaccttcaggcggccagtccgcctgatttcattttatggataatcattatgaataaatcgctggtagcggtaggcgtcattgttgcgctaggcgtagtctggacaggcggcgcatggtatacaggcaagaagattgaaacccatctcgaagacatggtcgcgcaggcgaacgcgcaactcaaactgacagctcctgaatccaacctggaagtcagttatcaaaactatcatcgcggcgtattcagcagccagttgcaactgttggtgaaacccattgccggaaaagtaaatccgtggattaaaagcggtcagagcgtcatcttcaacgaatcggttgatcatggtcccttcccgcttgcccagcttaaaaaactgaacctgatcccgtcgatggcatcaattcaaaccacgctggttaataacgaagtaagcaaaccactgtttgatatggcaaaaggtgaaacgccttttgagattaactcccgcattggttacagcggagattccagttccgacatttcgctcaagccactgaattacgagcaaaaggatgaaaaagtcgcctttagcggcggcgagttccagttaaatgcagacagagacggcaaagctatctccctttccggggaggcgcaaagtggtcggatagacgcggttaacgaatacaaccagaaagtgcagttaacctttaataatctgaaaaccgacggttccagcacgctggcaagttttggtgagcgcgtaggaaaccaaaaactgtcgctggaaaaaatgaccatttcagtggagggcaaagaactggcactgctggaaggcatggagatcagcggtaaatcggatctggtcaatgacggtaaaacggtcaatagccaactggattactcgctaaacagcctgaaggtacagaatcaggatctgggcagtggcaagctgactttaaaagtcggccaaattgatggcgaagcctggcatcagtttagccagcaatataacgcacaaactcaggcgctgctggcacagccagaaattgccaacaatcccgaactttatcaggagaaagtgacggaagccttctttagcgctctgccgctgatgctgaaaggcgatccggtgattactatcgcgccgctaagctggaaaaacagtcagggtgaaagtgcgctgaatctgtcgctgttcctgaaagatccggcaacgactaaagaagcgccgcaaacgctggcgcaggaagtggaccgctcggttaaatctctggatgcgaaactgaccattccggtggatatggcaactgagttgatgactcaggtagcgaagctggaaggttatcaggaagatcaagcgaaaaaactggcgaaacagcaagttgaaggtgcatcagcaatggggcagatgttccgtctgaccaccttgcaggacaataccatcaccaccagcctgcaatatgctaacggtcagataacgttaaacgggcagaaaatgccactggaagatttcgtgggtatgtttgcgatgccggcattaaacgttccggctgtacccgctattccgcagcagtaattcacagccaaaacgccggagatttttctctccggcgttttttcttacttcagcataaagtcatactgaatactcattttcacatcccagtaattcaggcgatcgcccagcgtactgccatcgcgcttttcccgccctttatcggcagcaagaaagaaattcatcccttgtaacggcccttcgctgacccgatagttcataccccctaagatacccgcgccttcaatccgcacatctcgtttactggattcatagccgcgggtcacaatcggtgcaaatgtcagcgtaaattgcggagttaaacgatagttgacgcccaattgccaggactgcattccttcacggttacgatcaagacttaatgaaaagggatagccaatgtcggtatccaccacggcaccattcattgcatggcgcaaataaccaccactgccaaatacgcttccccacg

(The sequence listing continues in the following parts.)

The invention claimed is:

1. A strain of *Escherichia coli* deposited at the COLLECTION NATIONALE DE CULTURES DE MICROORGANISMES (CNCM) under accession number CNCM I-3734.

2. An enteric-coated formulation comprising a lyophilized strain according to claim 1.

3. A strain according to claim 1, wherein said strain is genetically modified and contains one or more heterologous nucleotide sequences.

4. A strain according to claim 1, wherein said strain is genetically modified in order to express a reporter protein.

* * * * *